United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 59

SEQ ID NO: 866 - DNA, 736799 bp, Homo sapiens
ggaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaaggtaagggctggctgcacggcccggggcgcggggcgtggggcgctgggcgcgggcggcgcgctcgaggaggccagtgtggggcgcggggccgggcctgtccggggctggggacaatgggagggggagtgcccgggcacctcctcctctgcctctgcctccgcctccagccgccgccgccgccgccgccgccgccaccaccaccgccgctgccccggctgcctcctccctgaggtattgttgcaaatccttccttcccctcaccctccacccgcgggcgcctcgggaacccccagccctcccccggcgcgagcgcctccggggtggcaagagcgcagggcgcgcgccctgctctggcctggcccgctgtgcggaagtgccggccgcggcccaatcacggggtgcacgccatgggggagggggacccagagtttttccaaaagcgtcgaccccaggctaggcggggttggagccttgcgcgccccctgcccggacttttctgggcgcccagggggcggggccacgcccatccgcttagagctttcgcggaatcacagttgtcacagcggaaagggcctagacccagtcctccaagtcctcccattttacagttggggcagctgaggcccagagagaaggagggtcgcccggaagttatttactagaggccagaccataattcaaatagttggctccggacttaagttccctttctctaagcatttctctagcaccctgtgtgtggcagaccctgtgctgggtgtattggacgttgccctcaaggaactcagttgaacctgggagtcaaacctggcctagggtagaaaatgctaagtgctggagcaaaggcgtggacaaagttaaaggaagttccagggagggggtttgattttctggtccctgggacggccttttggagagtcctgcactgaatggggtttttggaggttgaggagtttcctgaagccagctagcggcttggaggaagacatctcttcgagggaaccgtgggccagagaagactaagtagtgtgggaaatggagatgaaagtataaatattctttagttggaggcaaggggttggggatgggggaggttgtgatatgagatgagctaatcagtggaattgtgcctgggtgcttggacagggcagagtctttggaacctcggagtcgtaggagaactgaaaaatctctctggcttcccttcccttagaagggatccactgctttccctcccccaacacaaaacaactagcgagaactcagggtcttctctggggcttttgctagtaccaaactcacttaactgtgtttccagtcccctttctctttccattccttccccttttactaaatctcttgcctttcctgtaaaattcactctcactaaggtgttgatgacttaatggcttacctttccctgcacatgtgcattttaagaaagcctaaagtgaagaaggggaaagtgtggctaggcacctttacaaagcatctagctccctctcccatcctcccccttcctcaactcttatagatagaagaataggtaaaggtccacgaaggtgggtgctagacctagagcctatggtcaataatggtggacagtggggggttaggacatccaatatggttttctccacttcgtcaccagtttttctgcttgcacagttcctgccagcaccagggggcagttaaaggaaaaagtgtgtgggccaggcacggtggctcacgcctgtaatcccagcactttgggaggccaaggcgggcggattgcctgagctcaggagttagaaaccagcctgggcaacatggcaaaaccctgtctctactaaaaatacaaaaaattagctgggtgtggtggcggggaactgtagtcccagctactcgggaggctgaggcaggagaatcgcttgaacccgggaggcagaggttgcagtgagttgagatcacaccactgcactctagcctgggcgacagagggagactgcctctcaaaaaaaacaaaaaacaacaacaacaaacaaaggagagtgtgcatttttgcatttaatttctacaatgcaggccccaaccccaacacccaaaactttatagtctagaatgtaggctccagaggggattacctattctgaatggtaggggtaaaagcctggggccttagggtctggcagtccccccagaggcaggctctctgtaagcagcatgggtctagagttggttttgagtgtacgcagagggaggagaagctgagctgatgagctgattgctgtggctgggacttgagtaggatctttcttagagtgacacattctggtgaagacagttccaggaaatgatggacgggagaggaaacttggttataaaggggcttaaaaatgccaggctaaggagtttggatatatcttaaattcatcatttgagggttttgagcaggctgagacatgatttagaggggaggtactggcatcgagaagccccctgctgcccaattccaatgagagaggtaataatttggcctaagaatattattggcttggcacgatggctcaagcctgtaatgccagcactttgggaggctcgaggcaggtggatcacctgaggtcaggagtttaagacagcctggccaacatcgtgaaaccccgtctctactaaaaatacaaaaattagccgggtgtggtggcatgtgcctgtagtagtaccagctgcttgggaggctgcggcaggagaatcacttgaacctgggaagaggaggttgcagtgagccgagattgcaccattgcactctagcctgggtgacagagtgagactccatttcctctgctgcgccccacccccccaagaaaaataatattatcaattggttcttgttcatttactcgacataggttactgaatacctattacgtaccattggcaaatatgaaaattttatagcagattcctgtattttattgagacaaatacgttgtatcgaatcaattgtaaaacacacttttttcacattttaatatcactgaaatgtggttgtcttattacaatgtaccatagttgtgcagttgtttttcatcctaagttggtaatggcacatcttatagttgatggcttaaatctgataaaattgttcatcatgtcgtttatgaatgtacagtgctttgcactttataaaacactttccaatcagatactccatttgaatctcaaaggtcccctgagaatgaggcctgctgctgctgtcacctttattttaacccttgcccaaggtcatatagctaattagggatgtgttcaaaattacaacccagaacttttgcttcttggtggtgacgtgtgactttaccctgctgttgagccagtctgggttaattgggaatggggcaagagttagatcggatttgatttcagaactatgctgaagatgctggatgatggggattttgtacacgggtagagtgtaactcataagaactgtgtagcccccttagcacagatatttgctgcattaagcagaaaaaagacagggagatagaaaatggcaggtagcaggtaaaacccggggttggagcctgcttacggtgaaccagaaactggcttggccctgagcgtacaaagatgaggtgtacatggtccctgcctttgaggagcacacaagtgtgtggtgtgtgtgagggggagggaaaaaggtggagtggggcatgtccgtgtattaagtgcttttacagggtaagttttggctgctcttcactgagaaggctcaccctcagggaaaccactatagagaggggggtgtctgagctgaacctctaggaatgagtaggagttgtccaggtggaagaaggacaggtgagagaaggacctattagcaagatagtagcagatgcagaagcagggagaagctgctttattctccaggctgtgttttgaaaggccagccatgaagaggaccatggaaaatggagaaagaagagggcctttactttttaataagtaaggtttaaattaatctcgataggggccgttaagtggttctgtagagattcacaggagaataaggctgggtagggtctctagcgtcatctctgtgggagtagttatttggatggtaatgcaggaggcatagtaccacttttagtctgagtgaacctgggactttgaccctgggccgcgattagaggatccaagctgagtatgttcattggtgggtgggacttttcctggaatctggctttggagggctgtgctttgctagaagaaacttagtagagtgaggaaggggaagatataatcatgttgatgcatgcaggaagctagtatctgggtgaaaatctgttggcttgagggaacatatgaggcggagaacctgagggcaaggggaagggtggaaggatttcaagtgtgttgtggaagtctgctgtaggctgcctggaggcttggagaaaaaggctggtgcattctaaatgttggtcacatcagtgagattggtaggtggataggtagctgtaggtagtgtagggattaatgtttggaagcaggtaaaccacagagttgaggctggaaaatgtttcctttcctatcattcttttttaatagtaatataattttgaaatattttcaaatgcttaccacctgttatgtaattatcatattgattcattaaagtaggttttttgattaccagtctcattttgcagatgagaaaatgaatttggtgaaataaggttacacaactaccaggaggcattcaaacttctgcctcattcttatagcctcttcaccactcttttctatgcccacatgcatgaaaagctcaaatcgacattgcttgtctgtgttcttccctggaatttaattcagcccacattcgtggggccctagtggggtcacaattgaggattcacatggacaaacgggcttctcagtcccacactggtgctgttctagcccctttttctctcttaagatgctaccttgggtgtcgtctctccccaaacctaactggaaaggactaagcctctctagcaaatcatctgcctctttcaacagagctcgcttccccagtcccttgttgtgttaagaatgtgatttattcttgtagagaggcagttagggtcataaagtaacagagtggggaagtgacagtcttgaactcagtcattacctttgatctcacggctccggtaacggtgctatatgttctctggtgctgaaccatatagcttctgcgtcctctaggaaagctttctggctcagggctctgagggaacacctacaatccttcctatcacctacctgagtcagatgggtcatctacattttggccactcacagataaaagcattaataatctgtttattgtgttgtgagaggagacagaccccaggatgttcagtagctgtttggtgaatgaacaatgtttatggacacaaataagcatgcatcaccacttcatcttacatatttgtgtgtctgcctcctctccactttaaaataagctgcttgaggattgcagtgatgtctgcttgttgatggctgtattcccaatgcccagaagaatgcctgacacatggtaggcactccagaaatacttgcttgatgaagagagggagtaaaatagttcactgcagccacaggatagcaatcatgggggagcgggactgtttttactgccccagaaccttgagccagttgttgctggcacaggtggcattgggcagtcctgccagcagagtgaagattgagggactgggagtgtagagctgagggttgtgagattaactatgccaaggttaattgcagttgcaactgctctttcacttttccctcacacagacaggtggtctggaacagtcctctgttttcttctcttttgagacagagtatttttttgtttgtttgtttggtttgtttgttttgagacacagtcacactttgtcacacaagctggagtgcagtggcgcaatcttggctcactgcaacctccaccccctgggttcaagtgattctcctgcctcagcctcccaagtagctgggattacaggtgcccgccaccactcccggctaatttttgtatttttaatagagacggagtttcaccatgttggccaggcggtcttgaactcctgacctcgtgatccacctgccttggtctcccaaagtgctgggattacaggcgtgagccaccacgctcagccttgagatggagttttactcttgttgcccaggctgtagtgcaatggcccgatctcggctcactgcaacctccgcctcccaggttccagcgattctcctacctcagcctcccaagtagctgggattacaggtgcctgctggcacgcctggctaatttttgtatttttgtggagatggggtttcaccatgttggccaggctggtcttgaactcctgacctcaggtgatccgctggccttggcctcccaaagtgctgggattacaggagtgaaccactgtgcccagccctctgttttcttaatccatgccttttcttatgctgttttctctacctggagtttccagcctttctgtctctgcctgttgtaaacctgtgattctaggatcaatatcaaaatctaccttgtgccatgaagcaatttccagactccttaacccttccaacccacacgtatctgtgatcagatacaactcaatttcatgtattgagttcggtacttgtgtacaaagtgattactgtatgccaggcagaaatgctagatactggttacaaagaaaactgagataggctctgccttccagagtcttccttctatcataggaaagaaactgaaagagaagatgctaaggctctaataaagtaatgagcaaagggctaatgggaacatggagaaaggagtgaccaatcatctagaagaactggtgaatgcctatggaaaagaagacatttggttgggttttgagaagtgaataggagtttacatggtggataggagtggaagagctttctagccatagggaccttggtgtatgtgcacaggcctgaggcctaaaagtatttgaggaatataaatgtgtgtttggagatcactgtgggagatggggctggctagggagggttagttgataaagagctgatgggccaagctaaggatgatggcagaggtgggagggagcaggaaggcttttattattattatattttgagcaaaggagggccttgttggatctgtatttcaaagagctctggtggcagactgagggcaggttaagaccagaggcagagtcccagcttagaaggctgctgaagtattccaggacaggagaaatgggcctgtatcgggtcagcagcgtacggagggaaaaatggattccagaaactgtttgctgctagaataatatcaggtagcttaattcctacttttgtccttctaattgtttgacagcttatccatcttggctggggaaaagaatttttttaatgtacaccaaagtttgtagtcaacaggagaagcagcaagctgccagccaagcatggactggggccttcttggccagagtgagctgatcccttgttatacagatgaggaaactgaggccccagaaaagggacagagctgctcaatcacacccttgtcagctgaagtggagttgggtcacagcctttactcctaggccagccctgtttccaggtatttttcattctcaatttctgctgtacctcacaccttccttccccactccaccctccactaggggtttctctgctttggagaattttaggagaggatgtaacttggaaattatggtatcttaggcttgaaacttgcgcttcatacttagaaagcaatcagattaagatggttcagtttgagtgtgtgtggtctggcgatttatttatgtaactgccatggatggctgccattgatgcttgtttgtgagaaccaagctatgcttccatgctaatatcaaggttccttgcttttgacagctccctgcccctgctctctaccattctccattaatatttacttatttttgcttgcctagaagtttttaggcaatagttttagatccattacaaggtagatcctcctgtgtttgtcttccctattgaacctgcccatcacaatgtatctcacagaaaccatgagtatttcatagccttcatagcacttttaatgtagcaaatacattttataatcatttgtattactttgttcccaaatataatgcaagagacaagttggctagatcagtcttatcttgcagatattggtcgggagttcaagggtcataaaactttcctaactggggtgcagggccttaagtggcagagtgagaatcaaacccccctctccaaaactcctgtcttgttccttaacttttgcaaatgagcatagttgatgtgaacatccctgcaagccctttacacaggtgagaagtagttattattatttcactagtactaattagtagcattaggtgactatattcaaggctttggaaggcaagactaaaaatcagatttgggacagggagttcaaagatctgggcttcaccataccggatcattttggcaatagtggtgatttttggtgtagggaaaacaaagacctatgtttgggctaaccacaagccctgtgatcttgaacaagttctggaacatccctgagcctaaattacctttcaatggagatcctgtgatctatcacaatgcatttgtgagaatcaggggcatttctgtgatggcgctttgtcagtggtaatgcagtctgtacatgtgtccgattctgggtgcccagcggggcatctggcacacagtgatgacaccttactgtgcttgtggggctgaaaggatttagacctagacaactcctagttcaagtcctcgttgtgctgtttaatacagggtgctcccttggtggtcacaggcactatttgttttctccacgtattcatttttagatctcttattaatgaggtcaccacagttgagtatagtgtgcccgcaaaagtgggatgagtgccacagacattcacgggcatttccaggttgtgcgctgatttgtcaccagtggatggctgtgcagtgtcccttcttccactgccaccatcccaccttctcttgggttttgtttgcactgtttgtatctgttacccgtggagggtctgcttctactgttgtaattgcttgtgttgtgactttgcatcatagctggagatccctctgtagttcaaatggaaagctggtgttgaaggtgaaaccaggtcttcttcagaaacttgtgtgggaacctttcatgggctggataagcatgaggatcaggacagggcagggtcactgaccttaaaggaggatgctttgacctgcctccagcatgcacccttcctgctgaagccattgttagtgtcccttaattactcaggccaccacccagcagcgcaactgtcaacttgcagaggacttcagtggtatcagtagtgttcctttttactctcataggtgtcctgattcggaggatacgttatatggtcaccctacttataggtgaatattgagtgaggtagtgtaaataatgtgcataaggccaggcataaggcaaggactcaacaaacatccactgtttttgttagagggggtgctaggtgctcaagaaatgtctgctgagtggccaggcatggtggctcacgcctgtagtcccagcactttgggagactgagttgggtggatcacgtgaggtcaggagtttgagaccagcctggtcaacatgatttaacctcgtctctactaaatatacaaaaaaaaaaaaaattagccaggtgtggtagtgggcgcctgtaatcccagctactcgggaggctgaggcaggagaatcgcttgaacccaggaggctgaggttgcagtgagccaggatggcaccactgcactccagcctgggcaatagagcaagactctgtctccaaaaaaaaaaaaaaaagtctgctgaataaactacatttatagaagtggaatttaagtttgtttgaagggtatgtcaagatcgtaagcacttactatttatgagggttgataaaatcatgttaatgtatatctataatataagagagtgccgtgggagaggcgcatgtgaaggactgatggacttgtgaattgctggagccttttggaagtgctgagccttcagttagacattgaaggatgggaaggcttagaccaggattcagcaggcagctgaattgctctggctactgagagttaaggaataagattggttctctgttcatgtgtgtactttagctgggtccctgaatctattattttccatccagtggcccatcttgataatgatctctagctgtaaccgtggaagcctaatgctctactaaactctgtgccaagaggtcacagtggaaattcatttccattatgcagagtcatctgcacttgtacttcctagtgaatttccactgaagatggttcttgtttagttcaaggaagaaaataacttggttggcacctggagcttctgtcttgtttggtatgaaaacgaatcattttcaggaagtgcaataaagagttgccacccacagggctgggtgtgccctgactcatgggaaaggcaaactctgccctggccaggcaggtaagtgacaccttttcttagaatgaggtgaaagataggtcagtgttccagtaggtggtcattgtcaccctggaagtctctcttcttggtcatagtttaatagctttacctggagaatatctagggttccagtagtgacagctggacaggaccctaaagataacattctttccataaatttgatacatttgtgtattcatttgacatcgtgtatcaggtgcatctgtgaaagaattagtgatatgttactctgggtttcgacgatggaaacgtgaatgcagtgtggtctctgcttgcaagaggtcacataaatcatcaagacagtatgtagaagtatatgcaaaaaatacctgaaggggctaggtgcagtagctcacattgtaatcccggtactttgggaggccgaggcaggaggatcacttgaggcccggagttcaagaccatcctgggtaatatagcaagatcccatctctaaaaaaataaaaataaaaaaattagccagtgtggtagtgcatgcctatagtcctagctgctcaagaggctgaggcgggaggatcccttgagctccagaatttgaggctgcagtgagctatgatcataccactgcactccagctggggttacagaatagactctgtctgtcaggaaaaaaaaaaaagtctgatggctctaattggatggtaactccctagggacctggggaaactcagataaagagattgtcatttgattgggcattgaagggtaagtgggaatttgtttggtgggatagaggatatttaagtgggagacataacatggatagagacatggaggtgagaaagtgcatggtgccttgaaaaattagagtcatgaaggtggactgcatagtagagaggctgtggagatgggttagggtctacattgagagaaacctttattgctgtactgagaagttgagactgcattctgaaaggagcattgagtagatcaatgagatgactggatctgtgccttaagaaaataatcagctatagtgtgctagacggattgaaggcaagggtgctagagacagcaggagctgtctgagctgctacaatagcccaggcaaatgataaagcaaaaccgaattagggttgaggcagtcgatatgagagatgactcacagatagaatagaagtcacagagtcttctcattttgcataaggggagactcagcacctaagaaaattacacgtgcaaagttcacagccctggtcccagcgtaacactgaggtgatctcgtctgcccagtgtcttagacgggtgacggaacatacggcttttgagagaactgcttgtcaaggaagatctccacccttttttatcttgtaaggattctgtgacatctcttaattctgaatgagatgagatggctctttctggagttactgaatctctaattgctggagatattcaagcagtgactgactgaactgttaccgtgaaagttcaggcattggttgaaaactcctctgcgaggtctttaagacctatcaaccctgatttttttttttcttctttcttcttcttctttctttttgttttttaaatttaattcctgggaaaagagacttataacagtcttatctgggaatgctttatccatttggctcctcaggattattttagacaaaaggcagagagagttaaaaatggatgattgagctctaagaatggtggcctgtagttcattcagagtagtgatggaacaaccatttcgttgccaataaattaatgctcactcatgtgggagatattggtagctggctcagcttgcaggatcctggtcaaaatggaccatccacatagcataatacttatcttgctgttgccatttcttatagggctttatggaaacatgtgttttcctacaaattacaggtaaatcataccagtagtcctgcggatggttattattattgtccaagtttaatcagaagcttgaacctgggaaaggttaaatgatttgcccagaacccaagcaagttaaacattgaaccaggacttaagttttctattatcgcaatgccagattcttcctgttccctgcctgtgcagatctctgagtccggctctagcttttgttcatattcatatccacagcatctgctgcaaatcctgggatgttataaataatttaataaatgtttattgaatgaacatatgaatgaatgaatgaatgaataatatatatgaagtaataaatgatgacttgagttttaagaatagcttaagaaattaaaaaaaccaccaccacctaattgagtaccttcttggcactttgacttttccttatagaggttacagtttttgtgtcttgcattacgtggttatcgctgagggatgtagtagaaactacatggatggtttggagagttagaaggtttggatttaaattatagctctgctaattgttagccatataatcgtgtactggttacttagcctctctgaacttccaattcctcatctctaaaagagtgtaatagtatctttcacataacatgattgtggaaggtattctatggtcagtgtagtaaagcctcaaagcctgccatgttggccgggcacggtggctcaggcctgtaatcctagcactttgggaggccgaggcgggcaggtcacctgaggtcaggagctcgagaccaacctagccaacaaagcaaaatgctgtctctactaaaaatacaaaaattagctgggcatggtggcatgtgcctttagtcccagctacttgggaagctgaggcagtagaattgcttgaacccaggaggcagaggttgcagtgagctgagattgtgccaccactgtactctagcctgggcaacggagcaagactccaccaccacaaaacaaaacaaaacaaaacaaaacaaaacaaaacaaaggcctgccatgcagtgccactgaaaaatgttatctttgtgtgtgtgttgtttttttttttttttaggattctctgtcaacccattagctaataatgcactcactgtatttttccttttatttctccaaattatgacctatggtagacccagtgtttgctgactggctaaatatgttttaagttctttcagagaagaattatagcacaaaagtcccaactatttctatgacttttcagatcagttgccagtcagcctccagaaagactattgacttgcacagtcattagcagtatgtgaatctacttgtttctctgtgcacttaccaggatttaattttataacttgcatttgtctttgctaaattaatatgtaagaaatatcttattattgttttaatttgaatttctttgattactaaaaaaatttcccaagtagtggtttattgtttgtgtttctctttatatggattgtcatatgacaatatttagaaatagtctgggctgaagacgcttgatataaaagggctaaaaatgtttaatgttttgagctgcttaaatttatttatttgtgcattcattcattctctcagtctttattgagctacctactccgtgccaggcacgtgctgcacatactatgaagaaaaaaataaatgaatgaaaacagtgacttccaacctcttcatttaacatgtgtgatagttgaagtctagaaaagtgaggttaattacccagggccgtacagcttgttcagtagcagagccaaccatttatttgaacagtaatgattttaaatgttttgtgtccatagccttttaaaccatggcgacatcctggaaatttcagtattgtgatgttaaagaacatctctaaactgtgtctacgttgaaaaatcagagtcctgatttttggtttagaaaacatggtcacctggttcttcagttgtaaatataattccttcctagacctctctaatgcttaagtctaaattcattcttaaatgaataaacttaatattaaaataagatcaggaagtaaatcccaagccaagcatttcagaccagttgtgaacctcttttgacatgtttttggtaaatgagaagaactgatgacatatttccctatcaaataaaatagacaatttagatttaataaggcagttatcttcaggtaataaaaattcaactaacttgccataactatcttgtttaaagtcaattaagagcctcatatttctcacttgctgggtaaaatttaatagaacttcagttaagcatttattgcttatttaattcaaaattaagttaatcaccacagttggtaacaaccactgagtatttaattaacattcagcaaactatcttattaagtctaaattagatacagacaagtcttgtttatccccatcagtttgcaaacaccacctcccccacctcccatcccaaggggcctttggttttcctacagttttccttttttgattcatcatttttattttcttctacttaagacttcacttgggtgaaagaggagaagaggcagcagtccatcatgttatagaaactttgggctcgtagtataactgagaaactttttcaatcttttcttttttcttcaatcctattctattaacatttcgtttttcaaaaggtattgagcacattctctgtgagaggcttcttttaaaccctaaggaagctataaaagaggtcattctgacatatttggttttattttctcatcctagaaatgagaggattgggtttagtttatccgtgtaacacgtattattggcttgcagtgtgtaaggcacttagctgagtgtttggatacaccttgattcagacaaggcccctgctcttaaagaggacacagaccagtgtgaaagctgcaaagttcagctgtaggaacatgaaggtcctttagaatgctgtgattctgtaagacagtatttcccaaagtgttaaggctgttttattaagaaaagggtcctgtagccaagtaagtttggaaaagtccaagttaaacaaaattaaggaaatttcagtattgtgtatctttaccatgggattttgagactttaataaacgaatgcgcattctgacctcccggaaggtttgtttcccaaagttatttgatcatagaacccctgcaccccactactaccctttgtaccagagcatttcctgggttcagtgatgtaatatgctttggggaaagctgctgtgggccgtggaccctggccacgaacctcccacagcccagaaggggtactcagacattcaccctagtaactatgatacagggtcagaattctactttgtctgaaagttgtgcacatagagtgggtgattttagacatagagtcttttaactggagtggagggtatgtaaccaggacagcctttcctcatggaggagcgctgggtctagcgggagatagactgtgtaggcagagaggcctggagggttgccagagcatcatcgggaacagaataacagtgaaattctgacatggctgatttggtggagactccctaacacattgatataatgtagaccaatttttattatagcctgaatatggagaggtaagaggcaatgaattttttggcgcagaactttctgccttcggctttgttccaactgcgtgactgcccatctgcagaagtgattgttgattcacgtctgtaagacattttcattctcatgctttgtttggggcagagcctctgccttgtgaatcactcttatgagagggagtctcagtttcttttcttttcttttctttttttttttttttttttgagagggagtctcgctctattgcccaggctggagtgcagtggtatgatttcggctgactgcaacctccgcctcccaggctcaagcaattccactgcctcagcctcctgagtagctgggattacaggtgtgtcccaccatgcccagctaatttttttgtatttttagtagagatggggtttcaccacgttggccaggctggtctcaaacttccaaccttgtgatctgcccgcctcgatctcacaaagtgctgagattacaggtgtgagccaccatgcccagccgagggagtctcagcttcttcatcaacagcatcattctagtcagtctagtttccgtttaccttgtcatctaccacttcctccaacttaccttccccccagcttctcttattctggtgaatcacctgtgtcttcatttttcattcttattcatctgaatcatcttcttcatctaaggcaaggtacccttttatatcttcctggaaagacatctacttcatttaaaataatgctaccaatttcctcccctctggtagcaaccagcagatggaacatgctagatgaggtagaggataatctacaaatctggtctgccatatcatgggagatttcacgtaacagtgaattctttcagagcctctcagcaataccttccttgtttttcatatctgtatcaaaaggaacactggcaaacctgggttgtatttctcattccattttgggcttgaatttttctgagtctgagtctcagtttatctgtgtatgaaacgttagggttacgctatgtgtactctcagggccttttaactagaaaatgttgaatttgaatgtttactaagtcaacacaagctgcagtcaccctggattgcttgatcctccatgtacttttgagcctggcagtatgaggaaactcctgcagtgagcatagttcatgcctacacaaagtaggcattccatgaatattggttctcttccatcctgactgcttctggattcattttctttttattgccattgctttttagtcacccaagcttatctctttcttgtctacaccctcaatgctgtaaatcttcctttctcattctccatctggatagcttcctctctcctcacctttttcccttcaggctatgcctatggatgctgtccactctgaaacctcccaaagacaaatgattgcaatggaggcacagattgccgggtggtggtcctggccagctacaaatctttccaagagattagcaccatttctttatggaatcatattgttgttccatgagtgagaccaagtcttatcctcaaggatcccataatggaggtgagatgctttctttttgacacttagtggaaacaacagtccatgaggtatattatcaattggaaaggtggggtttttgctttctaggattgggcaatgcactactaggttctcagcgtggattcttgagtatctaggaaaactggtcatgtggaaagcttaagcttattttgcaggccttgaaaagacagcctgcatgtttcatttcactctctacccgaactgacacttcagggatgaaaatgtcagcagacagccagcaagtagccgactagagggcatgatgtgggctggtggtgcaactcttcaaggatgatatgccagagagggcagaacacagttaggacaaggccaaggatgtcattcccatgtggagaggccattggtaacctcggcgaggtttggttcttctccagtagagattttcagaagctaagaattcaccttgagagtcctttttgcttcctcttcttttgtattaaacaaactactcacctctcagtctttgcctttagtcctttggctattcctggttagataggcccaattccagaagcatctggaaaactctgctctaagtatgtagtgcttaagggccagagctctggagctacactgcctggatttgcattctggcctgccaaaaatacctcaacttgttgctcagtatttttaggcctctgttgcctcatccataaaataataataagaaaattacttatcttgttgtgaggattaaatgagttaatacatataaagcccttagaacagagcctgacatgtgataagtgcccattaaatattagccactgttattatgtgttacccttattaagtcacaaaatggcgatttggaaaagataatagagattatctaaatgattgtgttttttttgttattgttgtctttttaaataaacttttaattttggagtaattttaggttgatagaaaagtaaaaattgtacagggaattttcatatactactcacccacttgtcctcatttttgatgtcttacattactatggaacgtttgtcaaaactaagaaactgatgttggtacattactgtgaactaaactccaaactatttagatttcaccagcttttccactaagttcctctttctgttccaagatctagtccaggatacccagtttaggatcattttaaaactttcatcttctttaatatttatttacttatttttttgagacaaggtcttgctctgtcccctaggctggggtcccccacttgtgtgatcatagctcactgcagctttgaccttctgggttcaagcaatcctcccacctcagcctctggggtagctgggacaacaggtgcatgccaccacacccagataaatttttgtattttttgtagcgacagggtctcactgtgttgcccaggctggtttcaaacccttgggctctagccatcctcctgcctcagccttttaaactgctgggattacaggtgtaagccaccacgcctggcccatattccttaatatttagagaaggattccttatagaaaagcctattacaggtcaggcgcggtggctcatgcctgtaatcccagcactttgggaggctgaggcaggcagatcacctgaggtcaggagttcgaggccagcgtggctaacatggagaaagcccatctctatttaaaaaaatacaaaaattagccgggtgtggtggctcacgcctgtagtaccagctactcaggaggctgaggaaggaaaatcacttgaacctgagaggcagaggttgcagtgagctgagattgtgccattgtactccagcctgggcaacagagtgactccgtctcaaaaaaaacaaaaacaaaaaaaacaaacaaaaaaaaccaacctgggcagcagagtgactccatctcaaaaaaaaagtaagaaagaaaagcctactatgacgtataatgttgtaatcatgtaatctggagcagctgcggatgaagtcgagcaggatgggacccacctttttttcttcccctgatttatctccctgaagggctccagcaaagcagggcttaaaagtcactgcattgagtctccttgttcttaggggaagagactgaggcccccaaaagtgaagtgacaatgctgggagaagctggaagcccagagaagatcagaaaaggatcttcaagataccttgatcctgtccttgttgaataaatgagtgagcaactatcggggactcccaaaaattagggtttggatccaggctcctccacctttcccctcatttttccttatctgtaaagtgggttcactgatcagtaatgtctcataggacttaaccctcacaaaatgccacagttttaccctgtgaaagttaagcaaaccgttgtgcccacttttagcacagcctggaacgtagtaggttctcaatcaatgtttgaaaaagaagccttgaaaatcaggaaattctccccttagaacttatttcaagaagattgggacaagctggtgcaaaacaaagaagagttattcatgaggaaatctgtgacactcaggaatggaaccagtgtttgagtatctgataagcaggatatactgtctgtttttattcttggaggcttttatcatacaatactacattatgttacagtctgactttcacacaaattggatcccaaaacttcttacaggaattaaaaatacaaactcgtgggcagtatgtgttttataaattacagaaaacagtagtgtaaagacatggcatagcaagtgcagcgaagcgtgcgcaggcattgatacccgaggaacgcacgcatgaggcagcagggaaggcacagcatgctgggtgaggcagcaggtgcacagttctgtccctggagcctggagagatgggggaggagggacatctctagctgggaggctgggtgaaggagctgaaccctggagacataaataccctgtatatcttccttatcctgccatttatggtcttattgaagggggccagctgacttctgaaacctcatctccattgctttccctcactcttgtctttgttgcagcactttctgcatttggattaccctgccctgccatcattacctgtttgaatccaattgatcttcaaggtccagcatattaataccacctcttccatgaagcatgccttgatttctgcccatcccccctaagcaggaaatcatcacttcctcttatggttccatggccctttgtctgtactgcttgcatggcactgatcacttcttaccttctcttgtagttatcaatatgctcgtcttattttgggcttttacttctttaggaccttctcgtctgcctggaacttggcaaacagtgaacatttgttggatggatggacaggtttgacactgctgacactagactcaaatttagtttctttagagtagaattttattttattttatattttttgagtcagagtctcgctctgtcgctcagcctggagtgcagtcgtgggttcttggctcactgcaactccacctcctgggttcaggcgattctcctacctcagcctcccaagtagctgggattacaggtgcctcccaccatgcctggctagttttctttgtatttttagtagagatgacattttgccatgttgcccaggctggtgtgaaacccctgacctcaagtgagccgcctgcttggcctcccaaagtgctgggattacaggcgtgagccaccacgccccacctagagtagaattttaacttgcttatctttacatctcccatgctggcactgagaaggtgcacattcattcatttcacaataaagtttcaggcactatttcagcagtaaacagtccatttgttgatagttaacacagagaaaatagtactcattgggatgtgtttttatacttgtaaggtcgatctggatttgtttgtttgttttgatatgtaaggaccaagaaagaaaaggtttgctaatctacgagtatttctggtgtagaatgcaaatgctctcttattccttcaactggctttatactaaaaagagatcactgggctcagaaaggtcctatttttcagataatacagcagttccttactgacttgcctcaggagtaaactccttttccaatttttaaaaggatagtaccaggatgccactgtgctcatagttgggcttttttgtacatgttaatttttttttttttaaatatagtgacagaatgcataccactgaggtggtaaatggaaaaaataagtgcagtggagtatactgtctgtttcttggggccttttctattaatcacaggaggaagcatcagacatgaccagatgagagagccagatgacccaagttcatgccagatcaaaatcagaatggcaaaattgggaggagttgatgctgttgaattgagaaagcataaggttctcagagtgatagagctggaaggatcataaaggtcatctagtctaatggttctcaaactcgaaggaacattagggtcatcctggagagtttactgggccccgtctcagaggttctgatgctgtaaatcaggcgggacccctgaattttcatttctaagaagctcacaggtgctactaatgttgaagagaacctatgatctagttcaacttctgggatttcttgctttctttcttttgtaaaaaaaataaataaataaatttaaaaaagagtttttgaagatggggaaatgaggcctggaaatagaaaagatttgcctagagtcacacacactgtcaggtcaggtagagtcaaaatcaggcaccccgactcacagactgcttcacattgccatcagagattgtcctgcaacaatattatgtttagttctactgcagaatgataactggatcttaccccctttgcctgatctggccacaaacttgtttttcaggtctttccattaggctctcttcagctaattaaaaaaaaaaaaatcagttaacccacatttattgaccagtgctgtgtgttcacaactgtatttagactagtggtatagcagtgcagtagtctgaaaacattttctcatctgtaaacaaagacagtcatacctcctaggactgcaagaagtcactgaacatatacctggcccttagtgtacacattactaaagagaataagatgtggtctgcaccctctcatgcaccagtggcttcttgagcagtatgatagagagagacagctgagatttagtggaaaaacacaaggcttagaattgggagagctgggttcaagccccagctttgccactaaatggctgtgtagtcttgaacaagtcacctgccctctctgagctataatttgaaatagacttagcttaagcaacaggaaagcagtaatgagctagaggaaggatagaaattgggaagaagtataaatctgcttaggagatggcaagtttggggctgaggtggaattgatctgagggagagacctggtagaaagagctaggcagtatgaggctgagtgtctgaaggggtagcaggcctgggggtggtccagtgatggttgaatgggtgggccagcccagcgaggggatcgcctgcaatccagtagagatgccctcattttcatggcagggtccccctgtgccagtagacagacccaggcctgggaaggagggctggttgaagtgagatggataccagtcttggagcatggttggagaatctgtccagggtgatggcatctgttttggattggggccttgaggcacattttcagttctgctccctggaccagcataggagggtggcagacagtacagtgatttgaatacaggattgatcctgccaccttgatttctgcctttatttagcggcaaagacactagatcagaaaagtactggatgtgattgctgtagtctttcatgattgatttaggagctgggagaggcctggctaggagttggaggatccctgggaagatgaagattaggtcttacgtgagcctcagccctctcctctgtaaaatgggagtaatgatggtaattatgctgatgttacctattctgactggagtaaggattaaagtacttgtctggaggaaggcacttcatggttaaaacatgaaaagagaagtgcacagtgtttttattacagggaaacaccaaagagctggaaaggaatgagggctggagagatggagctgccctgaggactctgggaggtcatcctgggggcagaactttgacagttgctgcccgaggtgggacagggatgctgggaagatgtgacgatgtgcataagtgtgtcatgttcaagatggttctaagccctggccaattccatacatgctcttttcctttctcatccatagaggttttggcaaaggcatacttgggagtgttgatatagctgacactgcagcaccctcagtttacaggtgtgagaagagtgaggctcccacagtctcacttggacaggtagtcagggctctgatggagctcctggagtttctaggttctctgtcacttgatagtcagtgctgggagggacctcagggaatcagccaatttcacagatggggagagtgaggcaggttgggaattctggccccagtggagggcaccacatgcccacagggaaatgtctttcccagccccctcctcatgcttctcctcttttctgtctggaagtcctagttctcctcctcacgctgagacccaggtagggtgattgtccatgtttcttcatttatctgttttttttctgttgcccagggactactctaagcaccatgctggttgctgactgttcgcttttgcaagatcttggaatctctgtttgttcacatcacaactcaagaggatacgttctcattctcccaatgtttgtcttctgcccattgcatcaaattgctcttccttgtttggaattaaacttctagcaatcatttacctttatggttctcttaacttcaggtcacactgttgtttagtcaatgtgagaatctttcagatgttctgcactttgcaaaaggatattcacagccaatgtgtgcggcagtgaaggacacttgttgattccttatttattgtctgctgttccagggaccggggactagaggtgaataaagccttgtttgggctgtctaggatgttgtgatcgacacaggaaacagacatgaaagccaaattggcgcagtgggtgaagtattgtaatactggtctctgtttatgatatatggaagaagtttcctagtagcagggtgggtgagagagtccatcatcattgcagattggtgcctctgtggacatgcaggtatattaggccagaggtggggagtgggagagagagggagagagagagcacgacaaagagagagagagagagtgagcaagagagagggagggagagagacagagagagagagagagagagagagagagtgagcaagagagagggagggagagagacagagagagagagagagagagaggttttgagagcattgatatggggtctacatattccccccggcccccattccctattatcatagaagcatgctgccctccaaggcttttgaatttgccaccgtgaagagcatgcatggaatcttcggctgtggccttgcattgccccctgtcttcgcagcggagcttctttatctgacccgtgcatgtgcctctgatgagcagcccttcatcacagctctgcggcctcctcctaggcccccgccttcagctctccagttcatttcccgccttgttcccattgccacctgcgggcttggagggccacctgacattctgtcctttgggtcccctgtgactccagagctccttcccttctggggcgcccacatctgcgacacgcttgtttgcccagtgcattttctacacttagagttcctctcgtgctctcatatttccatttaaagccctctcgagaggtctgtctcctgccagcagcattccttctagtttactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttcccctctccccctgagtgagcctttcttcctcttcctcctctttcattcagcctcatcctgccttgggtccatttgacagataatggcaccttgaggccttgtcttttgcatggcatctgtgcctgactggtcagaaattacttgtgaagcaacatagggggttgttggttgggtccacttttaggatgaagtcagaagggatcgtgagtgatgcttggccaataagaatgtattgatttgatttactaattaatttcatttccagacaccaatatatgcatagccttgtttgaagaaaattaaggagaaccattttgtaaatggcaatgagtgtaagacacttaactatcttcctgctctccctggcgtgggcttccgcgctccctgactctgcttttatttaaggtgtctgggaaggcatttgtccttcggcttcccagctggcttcttgccttctcactcactgcctcccgtagcctgtgggcagaatccctcaccgtgcccaccttgccctgctctcgtctgacctcacctctgtttccaggatttgctatggctgtcccctgccagtcatgctctgtgcttgctactctgagtgtgtccctggtcccactctcttgcagcctctgtgtcttagcacatgctgccctgatggcccaagggcccttcccctttgtttctgtctggggaatgttctgtctcctctttcttgaacctccttatattccctcaagaagacttaaggcaaaaacaaacctgaacttactatgtgtggtatttttgtgttataagtgtaggacctagtcatagtaacacatttcaaaaatatggaaccgtataaagaaaatgagcatcactcataaatcactatttagacacaagcattgtttacgtttctaatattctttctttagtggtgcttttcatgattttatgtgcatttgcattttactgactaaatattactatataaacattttcatatcttgccacttcacctaacaatacagcacaagcagcttctcatggcattaagaattgtttgtacatgtaattttgaatggctgtatgctgtttcatcttaagaatataccataattctaatttttcatcattataaatagcactgtgacgaacatccttcttaacaaaattctttgtctgcacctatgattattttctaaggtagattattagaatttgaaatgccttgcacaaaggacagtaactttttcacccttagtttcagagagaacatgttgtctctggagaaacacagaaacatgaaaaagcacaaagaagaaaataggcctggcacggtggctcatgcctgtaatctcagcacttttggaggccgaggtgggcggatcacgaggtcagggattcgagaccagcctggccaatatggtgaaaccccgtctctactaaaaatacaaaaactagctggacttggtagcgcatgcctgtaatcccagctactcaggaggctgagacaggagaattgcttgaatccgggaggcagaggttgcagtgagctgagattgtatcactgcactccagcctgggtgacaaagtgaaattccgtctcaaaaaaaaaaaaaaaaaagaagaagaaaataaaaaccacctgcagtcatttgcaacagccagtgtgaaatttgctacataattgtatctgtgtatctatctttctaccctacaggttgccaaacattttctgtaaaggactgggtagtaaatattttaggccttgcaggccatacatggtctctgtctcctcctcctcttgtttccgctgctgcttcaagattcttttaactatagaaaaattatttctcgctagtaagctgtataaatatcagttttcccacctggttctagcctcaaaagtggagcaattctgtacatactttgaaagcaatgtttaaaaatttatttaatttaattaattaaaaaattaattggttactttttagagacagggtcactctctgttgctcaggctggagcacagtggcatgagcatagctcactgcagccttggaaatcctgggctcaatcaattcttctgcctcagcctcccaagtagttgggactacaggtgcacgccactgcacctggccatgtacatactgttttgtaattgttctcttccacaatttaactacttcatcagcgtcctcatagttttctgttttaggcaacccagatataattactggctttctgctgggatgcccacagcactttggccagatctctgatatagaatttaaggcacattttattgcgagtatttgctgagatgtctctttcttaagtctaactcctcgtgagtctttccagcctcagcacatttcctgagtggtgcttaatagatgctcagcaaatctgtgtggaacgattgccttaggctgcaagtttatcccttcacaatgcctacatttagattgcaactccaggcttgctccttgggccagcagcatcagtatcacttagcacttgttaccagtggagactctcggtctcaccccagaatctatgtctttaggtgttgctgaaagtttgagaagcattactgtagagctcacctctgctatattcatcatgtacttatttatagtcatccctacctcgttcttttcattggtcggaacttcctgtgactagaccatgggtattccttaattgactgacacaatttgtttcacatacagcaccagctgccatctggcctagtgagacctatgtggctgccattgtttttggctgggagtggttgtgatagatagaggagggagcaaatatttaattagcacctgctatgtgccaagtcctgtgcccagctctttacacacattcttccaagggtgagacatgatggtgtttgctgaagggaacatagggatctttaagtccagtgatttttaaccagctaaagaattgaatatatatatataacatatgcacataatatatatacatatatgtacatatattatatatgtgcatatataatatatgtacatatacaatatatgcacatatataatatatgtacatataatatacatacacacacatgcccagcccttactccagtctagaatcaaaatctctgagaagtagacctggtcaagagtacttagagaaaattccctcagtgtttccattgtacattgctggtgaaaaaccaatggtctaggccagcatcctattgtacagatgagaaaggtgaggcccaaagaggtcaatgagcatcccaaggtcacataaatttaatagcaaggccagacctagattttgtactatctgcctgaggacacacttcacattacctgagctgcttctgacctgcagtgttggggtggaagtagaagtgggtgaagaggttgaactcttgtcctcggatctctgagcttgattgggcagctgggagtgtagaaaacaggcaccacgtcctggagtatcctttccattccccctccacctttgcccaccttccttatgtcctctttggggctatgattgaagaggcttgagacattgaagagcatcaatatctactgctctaagtgacccaggcagctgctgtgacatctggtgtcttcctttatctttgtagagtcatgggcagcacctgtaaaggcaggtgtgaaagaagctttgttctgattcttttttcactgtcccctctgtatcagacactgtcatgggagcccccggtcaacttcttgcttccagttgtgcccagccagcagcaaacagaatgagacatcagctgaagcttttcaaagacatcctgtggaagggcatacagacttcatgtagtggccaagggtgtgattagcactgattacgtggcaaagcggaatagaactaatgaccatgatagctgccatttacccagtgctcactgtgccaggcactctgcttgaatcatttcccgtaatcctgtaacagccatgggagggggtgggagtgggagggggtgtgctggggaggttttatggcctcccataagtggcaagctgggatgtgaacccagttctgcttgattttaaagtccatgaccttaattgtcgtactacactgctttcctagctggatatgtgcttataccttctaacctgccactgctaggaatttaagcaaaaagcccatagagatagactgaactagtgtgtaaggacctatggtagcagatgtcaaaaatggagtggactgtatcaattggtataagatttccagttgctggaggtgttcaggcagggaccacggtacctccttgtgggagactatcaaatggaagatttgactggccatcgcagtgcctctgggattctaattcatcggggcttccaagatatgaatttgtttggaagattctgtcatagagcaataaaatgtactttgggtaaaaatctgtggatagggcattggtgaggctctgaaggatttgattttgcacggactacttccagcaccgagagtcctgctgctggggtttcttagtgcctgccatgtgccctgcactgtttggctctggctgggccccagatgtgagaactttcccacaaggagctccccatccaggagggaagggagagcatgctgtcactgaaagataaactatccagtgccagggagtgtggggagagagacaagtgtgctgcctggggagcttacacgaaggatgcattcaatgaaccaggaaatttgttttttaaatattggatttgaactgggctttgaaggctatatggcattcctttaggttgtaggaaggtggtatcgggtcaccatactgagctgtgtggtgggaaaagcaggtcggaccctaatgtgagccttgagtaataaggaattgaagagtgagcctcctgggcttctttttaaagtgaatagggctccggtaaacttttttttttttttttttttaggatagtagagaaagagcaggggtacattttgtaattcaataagcatttgcattgaggccactgtgactggagcaagctgagcccacctctgttaatgactaagagttagcctgaaggagatgtaggttgggcagggcctaccaggaagggggactggctggtgtaggtaaaggggcagtgcagtgtcagcacctaggtttcgaaaggctccagatgctgagatggtgacagggtcttggacgtaagaagagagagctatgaaacacaggcacaggtacagtgtgaaattttggaaatccctaaaaatgaagccaatgggagtgctgctgtgaactgtgatacgtgtttgcacctggccactggcatatcttctatctctgtttgcagagacgccttctttttatacttcttttgatggtagaggaggaaaggacttgagtcttagagccaaggaggcctggttttgaaattgtcctctgttaatttacagctctgtgacctcgagaatgttgtttctcctccctgagttgcagactcttcatctgtgaaatcggggagcgggcggggtggggggaatattcttaccctgtagggcacaggttgcagggaaggagagaatatccactgagtccagtaaatgcaagtcaggaacattaatcttcttcactcgctcttgttttatccagagtagataactctgttttccccctatataccccacagtttatagagtggataactctcttttccccctatataccccacagtttatagagtggataactctcttttccccctatataccccacagttcatagagtggataattctcttttccctctatataccccacagtttattgcgtggataactctcttttcccctacataccctggctgactttgtgcctttgcccgtgtaatttctaccttccagaaagctactttttcttcacatgtttcaatcatttccatttgtttgggtcaagcctctgcatggttccttggacactctccctaggaatcccaacgggcagcggcttcccttctgtcgttctctcatggtgtgggtaattgttgacctaatgttatgttttgtgtttacacccctctcacctgtcagctgcctgagatcaaagttctgattcatgtctcccctctctgcagcactcagcatgaagcctggcacatagcgggtgcccataaatgggtcttaaatgactgagaaaaagaagcgatcaggctgacaactggcatttccctggctttagaaacctgagagaagaaaagctggtgtaggaaaggagtgtcaggcctgcggcttcctatttcctcattcagggcacaggttgggcttgcccggagccatagttcttgagacttaaccacctcaggcctaaatctgccttctttaattacctcctttccagggaacaggagtccttgttgtctgcccagagctgctaaatatagctccaacccccaggccttggtgtgcttctgggccacagtgctgcacagcctgagatgtctgttgattttggggtttcctcagggattctttacattttcaagttttcataagggactgcttcttattttgaagccagcaaagagacttgaagggcacagagtgttgaaaattttataggaggatgctaggagagagttaaagagcttgggtagagaaggggaaagagaagttcttaaaagagggctaggtggcttaaaaagacgaccttgtcatgcatttaatgatcttcaaaagagtgacatcttgtaatggttttcccaggaaagccccttcacatttgacttttgtgacctcttggtcctgctgttggcagttaatcctttctagcttgaaataatttttttctaagtttttttttttttaatttaaaaggtgctataatacaggcttacagtaaaaataaaataatgcggaagtgtttacaataaaacagtaatttcctgtcccatctcttcccaaaccggttccattacccatagtcaaccacttgtaaccattttttgtttttgagtttttttggtggttactatcatatttctaaataatatgcttctgtctcatgcttgagttactagttttagatatgcctattaaactttattttatgataggtaaggactatttatttatatccaattggtccttcccagttctcttcccaagtcttgacagttacatttctacttttattctttgtggtttcctttatgtttacagaatatgcataaatctcagtcttttgctatatgaacttttgacagtttcgcttcactcactattttgtaagatgaagatattagagtttccctccacttttcctctccacatttacccttcaacttgtcaataatgttttaggttaccttttgcatctcgagggtttataatggatacatgcatataggcacatgtatatattaatggttttatacgtatagctaagtcatctgtgctctgtggtttgattgcaaaagctgaaaaaataaataatatttacattatgatttctaggtaaatattgcttaatacagggctaagtcatgtgctgtggtttcatttccttttctggggttctgaggtcaccacctttaagccacttataggagactgaactttcccttagcatcaaaatctaatagatgattgtaattttttctgtagttgttcagagtcattctacattttgtttattttatttctatagtaaatagataataaataagcttcttattataatttcttcttatttcttaaaattttaggctgtattttgtttttgttgagagaaaaaattagcattttctaccatatctcttatgtattctgtcgttctcttgtctgcttggagtctgttctgtgtgtcttcttcaagttccagcaactttttctcttattttggactggtttctccatatctgggctataatttcttacgcagtttccccctcttccctcccacaaagtttctaattgcttccttttatttaaacccctgtgtttttattatggtttcagatatttccaggctttcatggaggcattcttctggagctcctgagtaatgtcattatctgttagtcatcattattaatattcagaagcagatatgttattaaaatattattcaccaattttttaataccaggcagttttgtttgctctttcttttttttctctactgaatattcatagacattctagtttattttttaattcctatatatttaatagccactctcctagtccactgagtggatgtactatttttaaaatttagccatttacatattgttgaatgggagttattgccagttatttgctcttataaataatactcttttgaacatttttatgcataaagccttttcattaaattattttatatgaattcttcataggggaagaaaactggaaagcctgtgtcatcatctttgaggacatatgccagttgactacaatggtgctaggttttagtggggatcacttggcatttcttacttaagatcctcttttttccttttggaaaggagcagtaagaattgggaggggagtaccacctctgaatcagcacatttagttttcttggcagcttttggaagatataatgtattgggacttattgcaaagttggtactgcctagtaattcactgagttatcaccctccttaaaggagtccccaggggtcagccaacactccatgacttaggcccatgatgctcttgtcacctaaaatctttgtataacaattatttggcgaagtgttattcagcatgatcatctccaactggatcatcacccttattcactggaattgtttctcggtgactttgggaaaaaccagattcattcttaaaactcaaagaggaattcccattgagaatatgctacaagatctacaactgcttctacacgtggtatataaggaagggtttgaggaatggcaggttgttagaatgaatggactgctgggaagaaatacatagtgatgggaagcatggtaattgatgtattgaagatgctgcatcattgttggtcaccctgcaccatggtattactataaaacttcatcaggctagcaacatttactctatggttatggatgaaatctgcatcacataattacacaaaaataggatccttgtctttgaaaagcttaacaattcatagatgaacactgatcatactaaaagaatatgtacctgttgccctatggaaaagacctaagcttaatgactcacagtctaattattttggttagtgggtgataatgtattggaggtgatgatgagacacatacatccaaaatctcacagcttggagaggatgtggtccaacagtgctattttatttatttatttatttgagacagggtcccactctgtcacccaggctggaatgcactggcatgactgaggctcactgaagcctcaaccacctcaggctcagtttgtcttcccacctcagcttcctgagtagctgagactacaagcatgtgccatcatgcccagctaagttttgtattttttaatagtgacagggtttcaccatgtttcccaggctggtctcaaactcctgagctcaagtgagcctcctaccttggcctcccaaagcactggcattacaggcatgagccaccgcactaggcccataaggaagagtttctgagatgtgcgagagtgataggcaggccagggccctctctcaggatataattggggccacgctgtggtttctgatatttgaggaatttggaattctgatttatttttgcctaagacacctcattctctggaatacaaattccacatctataaaatgatagggttgtatctgatggcctgggctttgtaaacccttctgttctgagttccataactctgtgattctgggttctgtcccaagtccaagatgatttgaaaagaataaaaaaaaaagaccttgctgaatcagtaccagcgtcacctgcttcagtctggctgggaagtaggtcagaacttggcagacacgagaatgtggttggctccaactgtgagctctgccagggtcctttgtagacacctgccttagaaagggtctgtgaaagaggggggtgctgacactcggaggtggggaagggtttatttttggctgtagatgctgcaagcgaagaggggtgattgatgagaggaggtattgggggacagggaatgaaagactgaaagaaggagaggagcaggcacgtattgggtgcataacttgtgtggagaaatggccaatattttttttactcctcccacacacactgtaacgtaggtggtaggtgtcattctgtggattttttttttttttttttgagatgaagtttcgctctgtcacccaggctggagtgcagtggcatgatcttgactcactgtaacctctgcctcctgggttcaagcaattctccctgcctcagcatcccgagtagctgggattataggcatgggccaccatgcctggctaagttttgtatttttttagtagagacggggtttcaccgtgttggtcaggctggtcttgaactcctgacctcatgtgatccgcccgcctcggcctcccaaagtgctgggattacaggcctgagccaccgtgcctggcccattctttggattttaattatgaggagattgaggcttggagatgtttaggtacctgtccagctaggctgctggtaagtgagggagaaggagtcaatgtggggtctgactccatgtcgcctcttcctttcacgctctaactgtgccatgctctgttctaggcactggggatatagtgatgaaggaggcaggcaaagtccatggtctcataagtgcttgcattctaggaggcaagacagacaacaaagtaaacaggtgcatatttcagagggtgacaagcgctaagcagcagagtatgacagcagtagaaggcaggagtgacagagttgcatgttgtgtttttacatcctagtccataagattgtgcactgagatgagctgatctgaggaaaccaacagctctagagtaagattcttgaggttagaatttagccccggccataatgtgaaccaactgtgaaagttgagcaagtcacctccccatcattgttaaaatgaaggaaaataatccctgttcttcttatttcactagatgatgaaagaagatgaagtgaataagtttgatgtgccaccatttttaaaactctggttggggccaggcgtggtggctcacgcctgtaatcccagcactttggggggccgaggcaggtggatcacgaggtcagagattcgagaccagcctggccaacatggtgaatccccatctctactaaaaatacaaaaattagctgggagtggtattgcatgcctgtaatcccagccacttgagaggctgagatgtgagaatcacttgaacccaggaggccaaggttgcagtgagctgagatcgtgccactgcactctagcctgggcgacagagcaagactttgtctcaaaacagaaacaaaaacaaacaaaaaacccagttggttttaaaaatacaaggagctgtttttaacagtttggttaacttttaaaggataccttcttatatttatttgctacgctttgtgtgcttggaggaaacaactgtttctttggttatttccttattcttagaatgaagacctcctttgccatcttcagaagagtttggatttgatttgtgggcatcagaggaccattaaaggtgtggagccaagagctggcctttaggttttgccactggaagtgggtgaggatggaatggaggggcagcagccagtggtcagagagatggcttgggtaactgtggaaactggaatcaaattcagtctgaccccacagtttgattcaacacagcagtcaggtcagccagtgagcaaacactcactgaaggtccactgtgagccaggtggtggctgaggaggggaggcataggagacattgaatcaactcagccgttgctacgagctcactgtagctgagtgttctggatgctggggagtcatgtgcttccggacctcaaggagcatcttttccagcagttaatatctgttctgttcccaaaagcatataaatcaatgttgattttagtaggcaagttatccatgcagacagagagacgatatttaaatatgtataacactgtattgaaataactctaggtctgccagaggggaactttagttgctggatcttgaggaggtttgagggttcctagggggggattgggaaaattgggatggtgttaggacaactaggagcctcaaaacataaactatttggcaatgagtaagggaatatttaaatattttagcaacctgtgttgctatatctctgtgtactgatgaatgtcagtttctcatgtggttataccactatcttatagcatcctcaatgtagtacttgatgtgcacacaaggcacagaggaggtagcgattagaaaggcttcatggggttggtgatgcttgagttgggttttgtaagatgaataggagtttggtaaagaactttctaggaagaagagagatcatgggcaagaacaccagtgtgtgaaacagcacaggacttgactggacagttgaggggttcaggtctaagggattttgtgctcaggtaattgtgagcacagtcgtcctgttaacagcagggaagaaaggagaaagagcagcacatccatttaatctctcccacagggtaggggaaatatcaagatgagaccatttttatttttattttaaataatagctatcacatgccaggtgttaggcagttagcaaacattgtttctaatctgacagtaactccatgaagtaggaattttcattcttcactcattctacaggttaagaaatcaactcagcatatttaagtgacttgcacaaagtcacacaatggcaagaacagggtttgatctcagtctcatctgactacaaagtctgaacgttccgcttttccactgtatggcctctctctcctgggaatttgcagtgagtgacatccatgagaaacagggcccttttcttgcctagaaatgtaagttgtgacaaaaactggaggtgtccgtatcctgttctgcaaaacgaggacaagagttcttgctccaggcgtcggcagtgctccggaaagacgaggcctcagatgtactgctttccaataccttcagcaagaccattctcagggagatgtttctctccatctttccttgctgcccctgagactttgacttgactttttactcctgtgaaacaacctcctgatggtgatagaaagaataggctgaccacatggacattttgtgtttatgctgttgtgacagggctttcttagagtaaatcaataacatgttcctggttgagatttggcctgtcctataacttgactttagggagagaatgtgctgattatgctgaagatagcgtgttggtttgtgtgtctttcatgtttattactgtacaagaagaagttggcgttctggtacctcccctccctcaaccattacaacaaggaaaacaaaatccactgagaggcagcatagcatggcgatgaagaacatggactgtgagctagattgcctagattcagttcccagctctgtcgctgtctagatctgtgtctgtgtctcggtttccttacctgtaaaacgggaatgatgataattgtagctactgtacaaggttattggaaaggttaaatgagttcatatttctaaagtatgtaaaaaattgcctggcatacaacaagtgccatgtaagtgtttgttaagtgaggacaacaacaaaattttataaacttgccctgctttccactgttccttacaggacatgatatttgcacaagtctgacctctgttgtgtgtggtcaggcactgaagggtgacatgttcacatgtgtggtctggtggacactagttttgatgactgctttgccataagaacttcgctggctatgggaaaatgtgtggttgagaaatagcaagtagaaggttctttttttttttctgctagtaggatagagtttgggttaaatggcatttgcagctgagtttatccatttttaaatttttcctggagttacactgtgcagcctatgcatcaatggttttatctggctcgattagtcagtggatagtttttaatttgacttaaaaaattgggggtcacataaagggaaccagcaaaagatttggattctgatgaacaaggtttaaggctcagctctgccactgacatgctgtgttacatgggcaagtccccactcaccatctttggtcctttatgtactcttctggttctcattgtttcttccctgaaaaaatcagggtgctgaatggtcaggtgagctccctattctctgttggtgagtggccctcattcctggtcagttagccatgggctattgagggaagatgttttatgaagtgtattgatggtaaatttagacagcaaaagaatccaattgatcatcttaattttttcctctgtacttcgtaattgtgccgataagaagtcctcatttcagctttacaccttttctaatttcccagatatttctgtgtatcaccagaaggcagaatggatccaaatagttattaccactcagctcttagaagttgtttgggctggagaaatgttttcattattaggacactttctgggtcctctctctagagaggcaactgagcctcaaccataccatctcccaggctcactccgtcctgcccaatctgtttacatctctactttggaggcaagctctatccagttctactaacctcagtgcgatgactcagggaaaacctagtttctttttcctaggaaaatcaggttgaccacaacttctgtagttcttgagggaagaagggaagtataatgatgttggaagtcaaaatattgacattaagatagccaagtggagttttattatgtatgtatgcatgtagacatgattgaaatgtatattacaagctcatatgacatacctttataatagagaggtacctgtggattctaccttacttttgttagtgttttcactgtttcatgtgagttttacaatgaacctgtgagatttgcagagttaagagttatatacccgtctatggtagaaaacacaggttcattcagaggagtaaagtggcttgcttgagatctgtgtcagtggtagtcttctgactagtgtttcacagagttgttttgacctaagaaagttagagcctgggccagacgcggtggctcacgcctgtaatcccagcactttgggaggccgaggtgggcagatcacctgagatcaggagttcaagaccagcctggccaacatggtgaaacctcgtctctactaaaagtacaaaaattagctgggcgtcgtggcttgtggctataatcccagctactcaggaggcttaggcaggagaattgcttgaacctgggaggtggaggttgcaataagctgagattgcgccattgcactccagcctgggcgacaagagcgagactctgtcaaaaaaaaaaagaaagaaaaaagaaagaggctgacgaaatttgtgatttttgaagcaacagaggaaatttagaaagaatgaaacttacgccgttaatattaagttataccaaggatctactcataatataacccaagactagaaacttaaagtactgtatagttgataaagagaacgaagccgtagagagtttactgaatttctcaatgaagtggcaagcatctatccatccttccattcattttgtcatattattagaaaaaaatacacagcatgccagctgccatgttgagccttgattcatcaaagttaaattagaatgacatatggcagtttagcatttaaaatgtggctagttcgaactgagatgtgccgttaagtataacacaccagatttcaaaggcttagtataaaaagtaatgtaaaatatcttattaataaattatatgatgttcattacttcttggaatgataatattttggatatattgggttaaattaaaatgcatttctcctatgatttcctgctttttaaaaatgtggctgcaggaaattaacaatttcatatgtggcttgcatcttattccttttggacagcactattctagcttgtgtctagtagaggaagtaagatttatacggacatgcttttctgagagcgtggcatctcgcttctttactcctctgcctttatatttgtctctactgcctcaccttcttttggcttcttaacccattctggtcggatggaagttgttcttgtccgggtctagagggctcagatgcattcctttttagcagtgctcttatttggcattggtggtgctgtttctgttgaccactcccagtgtctctggatgttttgttattcctttacctccctagcctctccttggggtttctttgcaggctcttgctctctcttgtatcccataaatacaagcattgcagagctttgtctcatgactgctaggtgtttatctccagtttggaactcctgaacttcaggcccacactcctacatgccttttggacactccagttggaaatcccaaagttgcatggggctcaccgtgtcttttggcattgttagcttggtgagtgacatcgcccaatcctggaaactgggactcattccggatggctcctctctgtccttcactcttgcctctgactgtcctcagtcttacagagtcaaccacggtaacacgtcctgcccacttccctcctccctctacctttggagcctgtcctccattcaggccctcagcatctctctcctggagtgcttcagcagtctcagctggccttctttttctattcttaccctcatccatcctattctctcttttcttcctgagtgatattccaaaaatgcaaatctgttcatgctatgtccctgtttttaaaatccttcaatgctttcctcattcagggcaaattaagaatcctttgcatgaattaagggacaggaatggaaagaggcaggaagtggtttgacccctgcctctttctgtcctcatctcactaatctccaagatgatcttgtgctctaggaatatacctgggattctctgtagctcccgtgacctcacacatagtgttcccttgtctgaaacaccattgcccactctatcagtcctttcaagattttgctctgataccacctctgcctggaatactcctctgactgttattgtctctgcttcctccattttaggccatttgttgaactgggctgcatttccttgagagcaatggtaattctttatatttctgtatcttcaaatcaaaaataggtgtgcaagtgatatttgttgagcaaataaatgccaaataataaattgtatagataagacattgtgggagttgagataaaaattctagccaggtagggatgggagcatggagggttcaaggaatggtgacatttaagattggccttcaatttgggtagtattgggtgggacagtgcagaggagacccctatagtcatggttattgtgccatgttctgcaggactgaaggatattgaataggcccattccctgctcaataccatcaccaccagagtagaataaggatggtaatctcaggagtccctttgggctagtgtctatcattttctcctgagctgggttatataactcggcagagctttattgccccagtacacagctggcatggcaggcaggcactccgatccttgcttgtgagctgccttggaggaagcgagtgcagaatggttgcctgcgttttcatctttacttctccttcacagccgcctttctgtatagcatagaggtgacctcagcaccagagacaggaaagaacacaatgagtcatctcaggccctaatgaggtgcataagggaccctacttaagagtgagggtcaggtgaggtcatgctatgcctggggtgagttttgcctcggggctccaggcggcactggagcagagctgagctaattttacccacaggagctgactgtgctgaagggcagggcttatgacattggccttatcatcctgtgatacccagaaagctcccaaggtgcaaccccgttatgtctgggctgttttcccctcttctagttaaatacatttttccattaggcgtgcatatcgaaaagcaggatgctgaggtgcaaagagctttggatttgggtggaaggccacggagttggatttggatctcgcccctacctttgaccttgcacaagttacataattcgagtctcagtttcctcatttgtaaaacctcattcgtatacctgtgtcctaagattgcttctaggtttacacacttggtgaaacgtagcaagcgattgctatgtgccagtcactgttctagctgctttattcatattgtttcacttaatcctctaaagaaacctatgaggatggtgttattgttatccctgtttataaatagggaaacaaatgcacaaggagcttagataagttgccccaggccaccagccagtgacagagctgaattcaggccagtggctccaggcaccacactcctaaacaatataccttattgttttgaaatgatagaaactttccttgctatatagcacaggcttaatgttttctaactacctgctgtgtataagggcctgggcttgatgctgggtaagagagcagcatagctgttgtgctgttctgtagacttgaatcacatttgtagatggaagcccttggtcagctgaagggtatggtggatagactttggtatctgacattgtaggcactgggtggagtgctcctcacacgacctctcatctcatcctcataacttcttcaatagtcaggcattggcatgcccattttacagatgaggtaatagagaggtagcatcacctcctcacatttacttggtagacagagcgactggggctgttgggtcccatgtttatgttgattcatttgcattccccatgaactgtgcagtgtctcagagctattattgttgcagaactcacccctgcccttctgcccaccactgacaaccctagagaaactggtgtccatgaaaaacgtgggtcaccagatgagaaagtcacatctgcatggtcagagcaggcaccaggtgaaggtaaaagaaagggctgggctttgttccaattgtttattactgtgtagcaaattacccccaaactcagtggtatacaacaatcgtttagtatgctcatggattatgtggatcaggaacttggacagagcaaagggggaatgacgcttctgtgctccacaatgcctgggatctcagctggaagactcgaaggctgggtgctagagggatatggttgctcactcactcacatgacatctgagacgttaaccaggcctgttggtcagaatatctacatgtggtctttccatgtggcctggacttcctcacagcctggtggctgcttccaaagggcaagccttgagaggaagggagagagggagaaagagagcgagtgagcattagcaggtgcaggaagaagctgtagatgcatcatctcgctatactttattggtcggagtagtccccaactcgcttagattcaaggggagaggcaatagactttacatcttggtggggtggccaagttctggaagagcatgtgggacggaaaatttgctggagcctttgttggaaaatacaacggaggctccttttggccaaaaaggaggaacagacgtctctgtggagctgcacggaggtagagccacagggtatgcagcaggcgcacctgtatggtgctgagtattcactggcaaatcaggaaaacaaaggtcaagccaggaatcctaaggaaaggatcagtagttacgctataaccatgcttcattgtatatgaattagcgtttatattgtccataaactagtttgtgtaactctgatttgctgattacatcgactgcttatgtaaccctggagttctaggtctattttggatttttttttttttctgtgagatggggttttcctgttgcctacctaggctggagttcaatggcgtgatcttggctcactgcaacctccccctcccaggttcaagacattctcctgcctcagcctcccgagtagctgggactataggtgcacaccaccatgcccagctaacttttgtatttttagtagagacggggtttcaccatgttggccaggctggtctcgaactcctgacctcaggtgatcctcccaaagtgctgggattacagccttgagccaccgcgcctggccctatttggcttcttatactaaactgagatattttttgttccttcacagaggcaagggagaagcttttagatatagacagacataggtctcagccaaataaataaagaatgagtgatcggttaatttatctatttttttttccctcctgcatctaacaaagttcaggaaagacattctgtataatttaacaggaaagagatgctaacaaagttattgaaaagactggagctactgggtttaagaatttttttttttttttttttctgagacggagtttcactcttgttgcccaggctggagtgcagtggtgcgatcgcggctcaccgcaacctctgcctcccaggttcaagagattctcctgtctcagcctcccgagtaactgtgattacaggcacatgccaccatgccccactaatttttgtatttttagtggagacggggtttcatcatattggtcaggctggttagccacaatccagggataaggaagatgtgattaggaagccactgctgaggcctcagaaacttttctcaacatcttaatagttagtgatggggcactggattggcctatggagtgtccttttgcccttcatgattccctggtattgcttgccagtagaaatagtagcaggaagattcagcttcacttccaccttccagatcacacacaaggaaatcttactggcggaacctaatttactagctttgaggaagtatggggaatgtaatttttaagtcggcttctgtgatgcagaaaggcactctagctggtggaaatagtctgattgagccagccaagagaatatatctacccccaacttatccatttaaaatccccaggagttattattctgaaatacttaatgtttataagtaattataacactgtaatataattacactatgaaattatgtttaatatttgtttatttatgtaaaatatataaacttaatataattaataccctgaaaaaacaggccagttgcccacgttcagtttctgaactgagttcttatttttgacgacagcagttgatttgcaattttccagttcagtttaatctcctcctgggagtcataccctaggacagttgtcttgtttacaaaatttcttcacaaacatttattaaacacttactatggacctgtccctgagctggatttggcaatgtggggagagagaagtcaaggattcttccactgggagccaatactgggaaggagaataaatcaggcacacagttagaacagggcaaggaagatgttgatcaatgccctacacagcaggctcagcaaatccagggaagagagattattctgactgggctgagaagtagagagttttatatagtctgtgatccggtgattctcttttgggggtagtaccatctcattatggggcatttaaaaatgtgacggatgccaggcgtggtggctcatgcctgtaatcccagcactctgggcggctaaggcgggcggatcacttgaggtcaggagttcgagaccagcctggccaacgtggcaaaaccccatctctactaaaaatacaaaaattagccaggagtggtggcgcatgcctgtaatcccagctatttgggaggctgaggcaggagagtggcctgaacccaagaagtggaagttgcagtgaggtgagatcataccactgcactccagcctgggtgacagagtgagattccatctcaataagacaaaatagcagcataatggggtgtcttctgttgtcccaacgactggagatcaggctgccattggcatttagtggttggggccagggaagttagacgtcctttaatacatgaagacaccacagataaaaaactgtctttctccaaagggtcatctcattcctgttgaagactacgagtgtgcttgatgatgtgtaggacgtggatatttggtgttgggagtggaaggatagcaggtcaagcagaggggacaaggtgagccaagagtttagtttaaataaagcaaagaatatgtgttgagtggcaatgggagaaagtttatggtggcaatagaagcttcggtcccggttgtggagaaactagagctactagataaagcacttggacttcccctgttgccattgggaagccatttcagatattggagcaggtccttgagagcagaaacgtagcctcgtcttggcaccatgcatcatgtaaacatcagtaatgctttttgaatgaatgaatgcctcaaactgtagtttacaggtgttagactagtgggtacctgagttttgccagatttaggatcctgtggttctgggagggccctggcagccagcatttggacttttagagaatacatggaaagggcacagtggcgtgccacacagatactgtctccacattgtggtcaggcagcagcagtacttgctgacaccgaagagagatgtgaaaaagagagattcttgcatggactcctgtgtgaggcccataagccatgaggcatgtagggagcagactgtgtcgtctgcatcaatgctcttgcatcttgagcttttaaaaaattgccattcaaaccagcaatttgctgacaaggttcacgcgctatgaccatgactgcagttgatcctggggagtggcttgcttgtctgcctggggatggcagccgcgtgcgttccctgtgctgtcctgtagggttgtggtggctttctgatattcaggttggtcccttttccttctttttggatgggctttcgaggttgggagaggaagctcagggatggaactgactaaacatatgtgagatgtttccttgtttgctgctcatggaggtttcatttctgaagtcttttcttgggagggaaaaggatgtgtggatatatgaggtgactctagaaccctcattttatggatgaagaaactgtgattcacagagggagagtgatttgtccagtgtcacgtggggagctggccggggagccagacctcctgtaccttttattgcagggtttattttatatatatttgctggcaaaaagaaggaaagagaaacaatttatatgttttttatttataataaaaatatttattataattatataataattaaattatagtaaaaatatttatttataatataaatataaaatgtatattatattataattatatataattatattgtaattaaattatatataattttatatattatatattatatatattaaattataatacagcatattgtaatacaatatattttatattaatatagtatagtaaaatatataatatataatataatttcattataataaaatataataaaaatatttaaaaatgtattttatatttacatatatatttaaatatatacatatatttatataaatatatattaatatttatatattaatatatatttttataaatatatatataatataaatataaatatatatttatataaatatatataaatatatatatttttaaatatatatatatttttaaatatatataaatatatatatttaaatatatataaatatatatttaaatatatatatatttttaaatatatataaatatatatttaaatatatatatatttaaatatatataaatatatatttaaatatatatacatatcaaatatgtatatatattttttctcttttttgtagagagaagatctcgctatgttgcccaggctggtctcaaactcctaggctcaagcaatccttctgccttggcctcccaaagtgctgggattacaggcatgagcccctggccttatagcagggtttaaattacacccactttgggggaagagagagtggtgtgtgcaggctttggtgccaaaggcttgcacatggttactggctcagccacttactataaaatttgtaaaataggcaccatggacacatctgatattaagcatttaaaaagaggagctgtgtgaaaagttttgttgactacaaagagctacagacatcttcctttttatcttgatgtggatgtttatgcactgggaattggtggggccatctttagagaaggggtgggccagtgaagacactactgaccataccccaatcagaaaacactcccaaggggctcacttccccactgtgcagtaaagaggttttgcactgagatttggaggtacagcacaaggcggggaaagcatgagccaagttttgagtcctgtggaattgagggtgcactcctgcctggggccaggggttcttgtagcaatataaagggagacgtggctaaaaacatagattgggctcatcctggaggccttgagtctggcctgagggtgagtggatgctatcgtttgtgttgtttagagcactggtgaggagtcaactgggaaaatctcaatgaaatgcatctttaggatgtgccgggaatcttggcagtaactcaggagggcaacagggaatcttgcaattggagtagcggggggtgattctcaagttttggacacattctaagtaactttttgcagtgcttcaactttttacttgagtttataataacaatggcaatattttttatagttgtagagctatatgaaatatttttacacctgttggcttcattgttcatacaatatcttagtgagggggaaggtaggattgttttcgttcctgttttacagacaaggaaattgaggctcagagagcagatgggatttctctggccgcttggctggttgatgtggaagtcaggagtgaggatgccaagtttcacacttcttcctgtgccaatgacctggaggagtgtttttctcaaactcacatttctttatcctccacagtcttgggtgtcactcttggaagtgtaagatggtcatgagtttcaaagatttctgagataagctgttaagattttcaaagatgagctatagagaatttgggacataaaatgtgtttcttccagtaactcttgcttgctatcatgttgttggttcaaattgaacatgttgataagtgccagggaggaaagaaaccagtacctgctacttattgggcaccttttttgccctgaactcagtactgcctgcttttccatttgagtatctagaaacatttatggatggagtgattgtaatattgtacaattctgtcaactagtttattagctaattctcataaaagccttaggaggtagataaacaatattattttccattttacagatgagaaaactgaggtttagagagatgaaataacttgcttataacttgcttgagagaacacaggtcctaaatagattataatctttttttttttttttttttttttggcagagtcttgctctgtcatccaggctggagtgcaatggtgcaatcttggctcactgcaacctccgccccaccaggttcaagcgattctcctgcttcagcctcccaagtagctgggattacaggtgcacaccaccacacccagctaatttttgtatttttagtagagacggggtttcaccgtgttggccaggctggtcttgaactcctgacctcaagtgatctgcctgcctcggcctcccaaagtgctgggattacaggcctgagccactgcacccagctgtaagtagagtataatgtaagttttctaatttgagacttctttcttccttgctgcaccccatctacgccatgtgttgcccatcccactggtgaaaatgcagagctgcttgttaaggaggtacatgtcagaccttggaatttactggaatcagacctggaaggtactatgaagagctcagaaggctggtggttttcaagctgttctcttctgagcctgagagactccaggagtcatcttgagggatatagcacggagggaggtgaaaagtggtgggaagtggaggaaggaaggggaccgctagagccaacctgagtcgctctgctttttcctattttgtaagctaaacattgtcaaagcatccatttaaaggaaaagttctgctgctacatataaaagttaaaaaaccactgtgtctacccttccttttgctaacactgagaggcagagtggttcagcacaaggggacacaaagtggcttagcacgagtcacgagatgtgacgggtctgagacctctcagcctagagctcccttacccctgggccactttgttagacacacctcctttaattcaaatccccgtctcagtgggacatggctttttcattttttcaaggaaaggtttaatctgtccagatccctgtgaagatcttggctcttggcgcacctgctggaggttcgaggtcctgcaaccacagagtagctgcaggaccttcaggatgtcccgagccacaaggtctttgacctgcattttgcaacctggttgtgtctcccctttggactctgggaaccttgctgagattggtacaatatctgtgctaaaaaggtttgaaattatagctagtattgtgttaccttcctggtccaaccttcacagacattgtctgactaagtatatataactcttgagtgttcactgtgtacaccggctcacaagaaaggcaaggttcctgatcccaaggatctaatggagagacagaaacaaatataaacttttgtcaactatttcagagacagttatttttgttatacaagattgttatgcatgctagttatgtggagaggatttcatctcttagaaatgagacggggagaatctgggcgatgagaaagaagaccagaactggggagtacagtctagaattgcaaggggttgagtttgctatgtgaagcagttagttttggactgttgcacttactatttctgagatttgagcatctgacttttcctttaagcttttgttttctcatttgtaatatgggagtgagagtgcctagttcacagggtcattgctggggttaaatgagataatgtatgtaacctgcttagtataatacctagcacagagtaaacactcattaaattttcattgttatcgttgttatgatttggcagcgaggagtcaaaagagcctattttcttaaactcatcaatggtataatcagagctttgcatctcgaagtaaaggaacactctgcttttattatttatttatttttcactctgcttttagacatagaattcaattgcctcaggctacaacaaactggcttcaatctacctttctgagttaacttctgtttatttctatccatctgcccacttctctcactagtgacctacacattttcttttttttttttttcttttcttttttttttttttcttgaggtggactcttgccctgttgtccaggcttgagtgcagtggcataatcttagctgactgcaacctcttcctgccgggttcgagccattctcctgcctcagccccctgaatagctgggattacaggcacacaccaccacgcctgtttagtttttgtatttttagtagagatggggtttcaccaggttggccatgctggtcttgaactcctgacctcaggtgatccgcctgcctcggcctcccaaagtgctgggattacaggtgtgagccaccgtgctccacccacattttctaagcttgattttaacttgctggtctttgtcatatcttctcagtcattgctggggttcaaatctttcttttctttttcttcttttttttttttttttttaaagatgggaatctcactatgtttcccaggctggtcttgaactcctgggctcaagtaatactgccttggcctcctgagtagctgggaccatagacatatgccactgtgtctggcttaaatatttccttctgtcggaatgccctttgttccttcatctgtgcccccctgctccatcctcttttaattcctagcccaaaagtctaacccacccattgggagggattctgcagaactcatagagtttacaacatcttgtccttcaattgcagtcagtctctgtcttgaactggatttgtgagctccttgaagttgtttgtatctcacagctctttgctgtaacatccctggggattcaagcacgcacacatagtagatgctcacacatctatgcaataaattactttagtgtctttctcaaatgatcagcacaggaagcaaatgataaaatgcaaaccagaaaacagacctcactgggctctgtgcttgtcagccttgggaatggatttctggcgaagatccggcccctctacaaatgacagagatgacttggctcttttcaggaattgaagagaatcctgacaagtggcatgttgggaaaggcctgaaggaagccagaccagcttgctctcagagctccttgggtcccctgcggcccccaggtgatcttcagcaagacctggtatgtaaatgagcctcatctgctggctcagcctgctgcccactgctagggatgctagaattccagggtaagcttctgtgagccgggctgggaggtttagtgggttggagattactagctttttggtatctgcagcttgaaataccttgtgcccttgattaattcatgcttgggagcatcctcagtgctctctggaaaatagctccttactgtatgtttatttccccacgggcttatttcagagagactggagcctgtgtttctaacagcttctccaaggaaaacatcgcaggccacgtttccggaactgagaatctcagggggtctttgaaacgtccatctctattacctccttttggcccagcatttgcttttagctgaaaagggagattttgtcttgagccttcctgtagacatatgtgacttggagtttgaaaatctgacagctgctgctgagctttgaactgcaagagtgagcagcatatagacataaccccgtagaacatcaaatcattttcctttaattcccagagacttaatgtttctttgtcttgcgaatgacctcactgctttttgtatttgtaatggaatgcacagtcatttgtaagtaatcacacaataatcccttacacttttataatgccttacccttttccatagggctttcactctcattatctcatatgatccttataactgctctgagatataagcagagcgcctattttaatctccaattttcaggtgtagaaactgaggttcagaataaagttagccagagttaaaacagttagtatgtagcagaattggaaagggagtctacagaattggaactggagtctcctaaaccagtgtttcttttgctccttattgctggtgtgaccttgggaatatacttaacctctctgaacctcagtcttcctatcactaaattgggtataatactacctcctgggatagttgttggaagggattcaatgagactgggaaatcatttaataaaaggtagaacacactaataatgggaggcatcattgtacttactacatgggccttgacggcgaacagtgccatcagaactgtgaaagaaaataacattttttctctctttttagaaagacacaggttcagaatggtgttgtcagggatcacaagctcccagccccgtgattagcaaattgaccctgctgccctgtctgctggctgctttcttattctgagaattgtgttgacaagaccctcttttcctacagagctctctcttaatgttgcttggaatagccttgtgtcctggagacagttttaggtctggcaggatctgagaacaggagtggggatcttggaatgggatctgcatccctgagcttcatccacaaagggtgggaatgtggcttgggctgtggggtggaggtagatgaacagctggacttgcaggtctatcttctgttgtttctcaataaagtagacaagtccatctgatgggtgtttagtagggtatgacttgtgagtccacaaggccagcagtatatatgctgaatggactgcttagcagtaacacactggaaaaatccaaaaagaatggatttcaagttggcaaaaaatgcattagaagtcagcagtgtgatgtggtcaggagaacaaccagagtgactgtgggatgaggtcttggatagctttgtttctatatacagtcagccctctgtatccatggtttctgcatccatggattcaaccaaccaaggctcgaaaatattaaaaaaaaaaaaaatccaaccataaaaaaatacaaataaaaaaaccaatataatataacaactgttcacatagcatttgcattctcaggtattataagtaatctagagatgctttaaagtatacaggagatactacctcattttatataaaagacttgagcatctctggatttcggtatctcaggggtcctggaaccaattccccatggatactgagggaacgagtgtacatactcacctacaaaaattccaaaccagtgagacagacataggttgaaatatggtcctgagaggcagaacgtgaagcaagggatggaaggccggggaggaaccagatttcagttccgtgtaaggaagaactttctgatggaaagatggaatttgcagtggcaggagataatgatctttgcttcactggagacctcaggaataccaatggggcaggcactgggcttaatggcctttatggccacttctaattttgagatcacagagctaggaggatgagaggcacacatatattgaaggaactgaagggtctctctctatgtggatgtggaaactgatctccaaatgtttgcaagatggagggtacgtttaaaatatttcattctggttttcatattgatctctgtggctctccccttggtctttggtttttaaagcttaagaccattcccagaagctcttttccatggaataatctcctttctttgctggaatgctcctgttgggatgcaggaagggactctgagctcctgacagaatgaagaccacccctttttgctctccagacctaattttgacgtcccacgcccacccgctgaggagggttgcaatggcgagatctctgtcctgaattctggttctggcatgcagtggaaggccctctgattctgtttccttacctattttaatagtaacttatatttgtgttccttcattaaatgtacaataaataataaatgtttgcttacggcatgcttgttaagtataaaacaaataatcaaaatgaatgtgtaatgaccctttggatagaccaagtagaagctgcttttaggacacatgattggaccatttctagatatctgcctaatttgtaaatgaaaaatatgtaagctacacaaggagcactgactcgtctaaaatcttaacgactgactgatttgggcttggggtttggggcttgggtccttcatgccctgatcagagctgtttatagcttgaagacttcctgggggtgagaacaagcaacctcttggtgcagtccaaagccaggaaatgggtgacgattttgaaaaaggactcatctgacctccagaaagcctttacaaccaacagtagaacgagatcactaagaaacagaaccaccgggaagccaagatgtggtacttggattcccatctcggagcacctcctatatcccgacacaccatttcccctagtgtctgatctctctttctcctcctttaattcagtctggagtcattttagatcagattcattcctgattggcttcactgctccaacttagtcatcacagaaccttagggttggaatccatgttacaagttaaactgagcaattcacccccacttttcctgacaacagtgttctcttgagagtctggttttattctgagtcttccagcccggtgtctgtgcccatgaaggactcatgccaaattacattctcaggaggactcccagaccaagagactctgggcttgggcgtgagagacttggggctgttctttttctttttttttttttgagaagaagtttcactcttattgcccaggctgacatggagtttcactcttattgcccaggctggagtgcaatggcacagtcatggctcactgcaacctccgcctcccgggttcaagtgatactcctgcctcagcctcccaagtagctgggattacaggcacacaccaccatgcctggctaatttttgtatttttagtagagaccagttttcaccatgttggccaggctggtcttgaactcctgacctcaggtgatcctcccgccttggtctcccaaagtgctgggattacaggtgtgagccactgtgcccggccgagaggagttgttttgagactcacctgccatcataggaaccatagcttaaattcttgtgaccttttcaggtgcatctcccaaaatatctcccctccaccaaattaatgatttatttcataaatttagttgcattctggatggtctcattcttaagatgagcttaaagcctttcagaccagtcacttccttgtttggggtggaggaggttttttcctggaataggacagtgtatggaagggttgagaatccacttctttagcggttaataatttactccgagtaaggaattctttgttaaagtggggcatgttcttcaagtgccagagaagagagaagggtgatttttctgacatcctccagcctgcttctccatatttggaaatgtttacccaccaggctgatctattggaagagagggaggtgactcagggtttaggagaagcaggatttgaattcttgtttccagaaacaaagtcgtccccccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtgtgagtacatcattactgccatttctgctcacagacctggggcttacagcctgtgggctggctcacttgcatggtgatgggacacgttgctgggagtgctggtcacttttatttgggggtgtggacagctgctttcccaggggagtacttcttacagtgggatttcaagacaagatcggcctgaagaaaaattatatttgtatattttttaaaaagtaggtatttcctctcatctgaggcctaacttgagttgggtagaaagacaatttgggagtgctgttgtctgatgattaaggctaaagcaacaagctggaagggatgtcgggatgtctgtggacatgtagggaggggtagttttagcttgaaaacagttatggtgggatttaagagtatgcaaaatgttgatgtgtagcatttgcacagcatccacggtctggaataccttgtgtgcaggtcactgtgtagatttgatgagttgtcagagttggaagagtcctgcagagttttcagcacatctgtctaatttcacagtgtgagataatgggcagcagagacccaggccctgaagacagatggctcattatgtgggattagaacccagatcttctctctcagttcgttctccttcccctagacttaagctgccccctctattgcgagatgaggaaattgggagatgttagaactgtccacacttactaatctagttggtgggaaattgaggactagaacctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacactttacctaaattattgtggcactatagctgcctttgagtaggaactattttttaaaatattatttttaattttggtgtaatacatataaaatttgccatcttgatggtttttaagagtacagttcaagcctgggcatggtggctcacgcctgtaatcccagcactttgagaggccgaggtgggcagatcacttgagcccaggaattcaagtccagcttggccaacgtgatgaatccccacctctactaaaaatacaaacattagctgggcctggttgcatgcacctgtggtcccagctactcagaaggtggggatgggaggattgcttgaatccagggagtggaggttgcagtgagccaagattgccccactgcactttaacctggatgacagatcgagaccctgtctcagaaaaagaaaaaaaaaaaagagtacagttcagcagtgttaaatacattcatattgctgtgtaatcagtctccaggcctctttcatcttgcaatctgaaactttgtacctataagcaacagctacccattttcctctcctccagcccctggcatcctccattctactttctttctctatgaatgtgactactctaggttctgtatctaagtggaatcataccgtatttgtctttttgtgactggcttatttcactaagcgtagtgtccttaaggttcatccatgttgtagcatgggtcagaatttctcctttttaagggtgaattatattctgtggtaatgaatataccacattttgtctatccatttaggtactattttttaacctccatgttatagaagaacagcaaccagagacttcaaagggttaattaagtaagtggcccaaagtcacatagtcagtagtggagactaattttacctaagaatggcatgtgatcaggagtaagcagatattggattctaattggcaagagtgtgacaaatcagggtgcttctcaactggatggtgacacctccttacaccttgctatggcatttcaataaagcaagtgttccaaagggctgtacgcagctatgcttcctttcttttgtattgggctctaggaagcccatagctaaatttaaagctcacctctagcaaatggtatgagacatccagctcttattttttgtatccctttctcctttctttgctttattttctcctctccttacccactttctcacttaaatcatgaactattagcatcttttgtcaggtacctcagatcatttctggaacaaggcagaatatatagatatgtggcatgatatctaatattttagtaattattaagtctgtggaatagtaggccaaaactggccatgatttttctgacttgactctgctcgtcttcttcttcttccttttttttttttttttttgatggagtctcactctcttgcctagactggagtgcagggcgtgatcttggctcactgcaacctctgcttcatgggttcaagccattctcctgcctcagcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatcctgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatctaattttattaaatctttattgagtttccacttaggtgccttgcactgttctgggcattatcccagtactcgatttagagcaaagagtaagacacacacaacaacgatctcttggtgcttacacgctgctgcaggtgtgtgaaggaggcagataaaggaacacttaaacaagagggactgataagtaacccaagggaggagtcacaaagggcattctgactgtgagtgagtggggaaggactctgggaggttatgtttaagctgagatctgagtgacaaggaggccaccttgtagaagttgggggaagagcactgcaggcagtggagacggtcaatgcaaaggtcaaggctgtgaagtgggaaggagtttgtgtttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggcatctttccagctgctgtggagggaacctgatagtaaaagggagtcaagggtagaagcaagaaggttaggctagacttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggatggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggggtttgaaagcctctccttgtcttgaggactggactgcggtccaagggcacctaccagccctcttttttcatttacatttgaattcacagttgctgccctttggcagttccctgtaattccttttaacaggctgggctttcctgcagatacttcatttttcaggtcttggagaagttaggtagtggctgaatcaggtagagaatccaaaattctgaccaagccccatcctctagccaccaggccaaagcaacttagcttgtgacctcatcctcctgtgtatcccctggcaatcttatactataatcagcctaagcccagagatgctcagaaatcatacactaagtcatctaaaactcatttctgaggctttctcatgcgcccctcttgcagtctgtagttaccaggttttcaaataattagcataatctcttaaaaacagtgttttgttattgctcattcaagtttcttctaaaatttcttttatattacctattcattgagttgacaaacatttattgagttcttactgtatgccaggcattgtgctaggtgctggggattgattcaaagataatttggaggcgtatggaaggggagtggataattacagcacagtgagataagtgctataatagggggatatataaagagccagaaatagcactatgaataacatctttgaacaaattgccttcttttttccttttggattattcccttatgtatattgcccaaagtgggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattatcgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatattgacctgaaaggacccaagggcgcattattcctgaccctggctcaggtgctgaaaggctatttgcatagccctactgttagagcacagaatcccaagtaaagctgaaaccatgccacagttttgctgtgaaacatttattacttttctagtacttaacagtattaagtaaaaactcctgcccctggtatccaggacctgtcataaatggacaccaacatcggtccactgtgggtccatgtgggtccttgatgctcctgcttacatatctttaaatcaaacacatttcctaccaacccccagatatatcttgcactttctcaccttcatgccttagcacatgcctttcctttagcctgagataacctctccaatcttcattcatagaactcccaatcctcctgtaaacttctgcacagacgccatcttgggaagggaataatccttgatcaccacctgctctcccatccattagaagtgatctctgtgttctctgttctgctaactcaaccacagttagctgtgaggcaatagagtacaaatgtatgctgcatatgagcatgggatatggatttgaatcccggctgtgatacttcctcactgtcagttaacttgcttgagcctgagttttcccatctgccagatgggtgtgatacaataggtgctccccctgaaacccaccatgttgacaggagtagtataaaaatggtctgattctcccggtgaggtcacgtaaatctggaatcgtcaacaattttcctttcctttgttgtcatgacttttttttatgacatcacctcatgtcatgtcaccgtgtggtatgaaaatttgcattgttacctgtgcttcttctgtggcacttgtcctcccttacttgatgtcttatctctccttctagactgggagctcttcaagggcagggagggcattgcatctttgaaggccttgacatatggatactgctacaaagtttcctttaagggaaaggaggattccatacaacctaagtggtgacatcagcacaggctcattactaatctcatgtcacgaggtttcaggcctggctgagaactctgtgagctctgtgatgttgagcttcaggcacatagagtacaagctgggtaggcctctggctcctgcttaagagacagcagaaaggctggatggagcctgtctccagaccagcttcttctgattcaaggagttgggtgggactggcagttcactgaaggcagagtggtagtcctgcttggaacgtgaaactttgtttctttcctgggccttccagtgggtctgttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaacgcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacagtcaggagacatacagtatctaacaaacttagggaatatgcttggcttacaagacgtggttttagtccacataaattagaatcacagaactataggctttgagaaattataaaagccttggaaggggtgaacgtgaattagtgcatattgtgtgcaggctttgtgccatacgtgctagatatgggatcccaggaaatggttgcatacaccttgttgggtagatgatattaaccctgttttgcagacagagaaacctgagctttgagaaaatcctttacacaagtccaatatcaaagtctggaacttcaaactgcactcctgatggcttctagaaatcctttccatttacagatatgacaagacttgctttcacattgttgattttttttttatcctctctttctctgtctctgggggcagcactaattcagggccagatagaactgtgaaaatctgcagtgttgatgtcacataacttgtttaatgaatctagattagtgtcttgacttttcctgccaagaatctgctcataaagtgtcttgttttgagctcctttaactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcggtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaaattgagaagcactttaacaactggtaatttaaattgcgtttgaactctgctaatggtttgtttgcatgggaacttcaatcatttcacagtggttctttagcaaagctgcttgttctctttatggaaaataagaaaaaattattaaaagagaagttggctatggaaaatggagaccactttcatttgtgcctggagggaagctggagagtgtgagtgagactccctcagggccaagggtggagagctcttcctttcagtgaagtttaaaaatctgggaagtcagatgccctttgctgctgttgtagaaactgttgtgatttgtatctctctctgcaaggagaagctttggttttatgcagcttgcgggtgagggtagggacaacctttttcgtttgttttatgaaattgcattgttcacaggtctaatgttggcttcctaacaacccatttctcagtaagtttgaaattatgcctctctctcctttcagtggaaatggctttcagaattccaatgtccttgaagaccactaggtctcaggaaactccttgcttttctgggctgatagtgattatactccattttgcctacttaatttctgtctgctgttgaggttactgggagagcgttgaaataggtgttcgaggcctggatttgtaagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactcgtgatcgtgaggacagcaccaagaggatggtgctaaaccattcatgagaaatccgcccccatcatccaatcacctctgcaggccccacctccaacagcaggtattacaactcaacatgaaattcagaggggacacatatccaaatgatatcaaggacggcttactgggaaatgtcaagattgtttatccctctgctgctcactgattctcacttttcaggcaaggaaactaaagttcaaagaacattaggtcctatagttagaaatttgtctccaaactcatattccttttctttttttatttggtatagtttaggtttatctgttaatttttttcttccctacaatttgagtatctaactgacttgcctctttcacctccattattaagatgaagctgttttcccaggagaactaggagagctgagatatgaacactgaggcatcagcattctctttccccatcattctgagtcaaattagtgaaataagagtgccaggatctgactaggagtttaggaggtatagaagtaaaccacggcccagtcagagactttataagcctgggaatttctgaagctggttaagaccctagagatacataagcaacacccttctgtttttcataggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatgcctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattattggttcccagtgcatatgaaatttatgtttacactatactgtagtctcttaagtgtgaaatagcattatgtctaaaaatacagtatacataccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgacacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggtaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctttctctttctttctttctctttctttctttctttttctttctttcttttctttttctctttctctctttcttttctttttctttcactctctctctctttctttcttctgtttcccctcccttccttcctcccttcccttcccttcccttcccttcccttcccttcccttcccttcccttcccttccctcccctcccctgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctttctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacatgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttatagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgaagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttcgctcagactcaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggatttttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgtcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaagaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatctttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaactttttttttctttgaaacggagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccccccaccctccaactctgtctctctctctctctctctctctctttctctctctctctctctctctctctctctgtctgtcctcctctcctgctgttgccatgtgaagtgcctgctcccttttgacttctgccacgttgggaagcttcctgagcctccacagaaggagatgctgctatgtttcctctatagcctgtagaactgtgagccaataattcaacaactcaaccacttcttttcttttctttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacccatttcttaatctctctaagagacatggactgtgttaaagtgtgtttatgaactggtggtcgagggtgcatttccctcctaagaaaactcattccttgttatgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttattctccattcccatgatttagccctctaacttcatgcatttctttttgccctttttcttgtgctggattttagcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacacgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacccgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaatttgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagtgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttatatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttctgaaatttaaaatgggcatctcacttctgtgttccctccccaaataaatgtattgatactaaaaaggaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttatttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagtggaggtgtaaaaactagtcttccagcctccagtcctgtctcagcattgctccccttcacgtcgttgtccagagctcctggtggagccttggccttttccatatgtacacgtgcacacacacacacatacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctctctctccaccccccaccccccacccccacccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggaggttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttctctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagcgtcctgaccatctgtttctttctaccccaggcccattcccatcatgagtatttattctgcccagtgtgggatgggttctgttctagaagtttgcatgagcagagggaagcttagccccatgaggccagtcatgaggctccatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccgttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccatttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagactttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattctcagggagtttagagacaacataatgaaggtattttcaaggtttggggagctgcttggaacttgattttggacaaaatggaaggaaaacaaccatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttgtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcacagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggtgtgcaccaccatgtccagctaatttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttctctcctcctcctcctccttctcccttctcccttctcctttctccttctcctcctccctcctctccttctccttcttctttttcttcttcttctttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacagaaagataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaattttttttttttagttattcttattttctaattattttatatgctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttcttttttttttctgttttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattgaacaatgagaatgcttggacacaggaaagggaacatcacacactggggcctgtcatggggttgggggacgggggagggatagcattaggagatatacctaatgtaaatgacgagttaatgggtgcagcaaaccaacatggcacatgtatacatatgtaacaaatctgcacgttgtgcacatgtaccccagaacttaaaatattaaaaaaaagaaaaaaaaaagaatttgcatctatttttagactttctgttctattcatctgtcacttcatgtgtcattattatgctttcaattattgtagctttataatatgttttattatctgacaaagattccccattcctattagtttctctttttcagaaaatttctggcttttaatgcctgtttatttttcattgacctttataatgaacctatctagttctggctgggcgtggtggctcacgcctgtaatcccagcacttcgggtggctgaggtgggcagatcacttgaggtcagaagttcaagaccagcctggccaacatggtgaaaccctatctactaagaatacaaaaattagccaagtgtggtggcgggcacctgtagtcccagctactcgggaggctgaggcaggagaatcgcttgaactgggaggtggaggttgcagtgagccaagatcccgccactgcactccagcctgggtgacagagtgagactccgtctcaaaaaaaaaaaaaaataaaataaaataatgtaaaaaagttctgttgatatacttatgaggtttgctgggtttatttgttagcattacatgctatacattgtaaaaatgttgattctttttcttggaatactaatgcctttccatttgttgaaaccttctttgatgttcccaggagcactgagatttttcttcatgtagaccgtgcctgtttctaataagttaattttgtagatattttctacttgctctagttaatgtaattattttctatttcatttaattatatgtgtgtgtgcctctgtgtttggggtctggatttcagtacattgattttctgctcagccactttactgaattgtctcattatttgaataattttagataaattttttttgagtttctagttaagtaagtatattatctgccaataatttatcctttctttccaatttttacaacacttatagctttcttctaactgtactaatacctctagaatagtaaatattaaataactgtggttgagtaaatgtccttcttttgtgtctgagtttaatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaacatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaaccatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggaggttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggaagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaaaaaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagtgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttaggcatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaaggccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttaaagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctaactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagtctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcgcaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgttttcccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgttttttttttttcctttggatatatgaccagcagtgggattgctggatcttacgatatttctttcttttttttttttttttttttgagacggagttttgctgtgtcaccaggctggagtgcagtggtgctatctggctcactgcaagctccgcctcctggcctcctgggttcaagcgtttctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtggttttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcctctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggaatggtttgagacataatggtcattgtgatttttcaagctataaaataaagcatgatgttaaaagatgattaatgttttcatttggtggtagatgacaagtttcttgcagggcatctgatcaatcatgctcttttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgcgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatatatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaaacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacccacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctagtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcacgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcgaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttattttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctaggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttctttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggctttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactctcacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcaatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagaggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttttttttttttttttttgagatggagacttgctcttgtcgcccaggctggagtgcagtggcgcgatctcaactcaccacaacctctgcttcctgggttcaaacgattctcctgcctcagcctcccaagcagctgggattgcaggtgtgcaccacgacacctggctaattatttttgtatatttagtagagacggggtttcgccatgttggccaggctggtcttgaactcctgacctcaagtgatccgcccgtcttggcttcccaaactgctgggattacagacgtgagccactatgccaggccagttgtgggaattttataagggctttttcttttctttttttttttctccctctggcctagtttgtggggagaggtatgtttccccaaagatgtggagttagcctgttgatgtaggcatgggagagtgagcttagacagagatgcctctcatataaggtagaaagccttccatgcccaacccaagtgttgtagaagttgaaaggggaaaaaactttttcaaaattggcttgacagcaaaactcctctcagtgtcttcttttttgtccccctctataaatggtaggttttcgtagtatcatgaccctttttagtaattataaattaatataagataaatttatggtattccttactatatagatttgttaaaataattcacgatatttcatatgtacacacaagctccttcaatccaattagtaagaaaaacacttcatgtcactgttaaataacatgaaaataaacaactggttaaaaaacaaaacccaaatacaaagcgttgagcttcctactggaatctgaatctgggagtgtcttgttgtaagaaatgttttcagacctatcattttcttttgtttctttttctttttttctaaacagactcttgtcagttctcttctgattagtgttcccctgggcttttcttcccaaaataaagttaagtgcattcaagtttctgggatcttctttacatccttttgaaaatgcagagtaaatattatgttggcttctttttgttttttttttttaaattttattattattatactttaagttttagggtacatgtgtacaacgtgcaggtttgttacatatgtatacatgtgctatgttagtgtgctgcacccattaactcgtcatttagcattaggtgtatctcctaatgctatccctcccacctcccctaaccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaactcatcatttttatggctgcatagtattccatggtgtatatgtgtcacattttcttaatccagtctattgttgttggacatttgggttggttcgaagtctttgctattgtgaatagtgccgctataaacatacgtgtgcatgtgtctttatagcagcatgatttataatcctttgggtataaacccagtaatgggatggctgggtcaaatggtatttctagttctagatccctgaggaatcgccacactgacttccacaatggttgaactagttcacagtcccaccaaaagtgtaaaagtgttcctatttctccacatcttctccagcacctgttgtttcctgactttttaatgatcaccattctaactggtgtgagatggtatctcattgtggttttgatttgcatttctctgatggccagtgatgatgagccttttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagtttccccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcgtctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtgctgaaaaaaatgtgtattctgtcgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgcctttttttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgagagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcggctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcattcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcaagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaaatagcatttacattttggctcttgaaataactaacagcatgtcatttccaaagagacgttaatcattgataccaccagcagcaaatgttctcattcatcagaccacatttgttttacacgttcctctccttagaaagagataagtatggtttcttttctttagttcttgctaataggatacccaacatattgaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtagtgtatgtatgtgcatgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaattcaaaaatcagtcaggcatggtggcacatgcctgtaatcccagttacttgggaggctgaggcaggagaatcgcttgaaccacgaagtcggaggttgcagtgagctgagattgcgtcactgcactccagcctgggcgacagagcgagactctgtctcaaaaaaaaaaaaaaaaaaaaaaaaaaaaaaaaaaaatttcagaagtcccggagtcctttccatgatgcatttgaagggccagagagatagaggcatgccctatgtagtacatcttgctgctgtccctcgtgtgtttaccctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtgcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcgtgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggcagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacatttttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagtcttagtattttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaacagcctggttcatttttactgtgttgccattggttaatgcttaaccagattttgtctctgtttcaaaatcttgaaataaaagtggaacaacttccaacatgacttaagaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccgttaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataataatcaaggacttagaagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggttctctatgaccttttagctcttaagtagtctgtcctggctattgtcaaccatgtctttttttccttgactgatagaaactgtggcaaactaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacgggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagccaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgtttaaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctacgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgactgtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcgagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttgtatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttccttggagaagttagggaaatgttcacagagttagagacatttgagctgagacaatataaaaatatagggcttggtagaacgtgaagagagggaaacggcattgttgatggtgaacacagcatgagcaagggttcagaatcatgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctccggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggcctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaacgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttttttgagatggagtttcactcttgttgcccaggctggagtgcaatggcattatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataactttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggcggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggacaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaattcgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacatactttttgatggcattgtttgtttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaatgcttttctttatcaatgttgaatattggcccccattctcttctggcttgtagagtttctgcagagagatctgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgacctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaatcctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcattacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcatatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattcttttgtagtgttgcttacgttttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcccaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatggtctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcctggcagggttatcttacgctattgaacctcagtttctccatttatccaatagagatggaaagtattggcctgcatttatttctccttcaaatgacatattgtatagaagcgtatcgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgatttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattacaccatagcagtccagcctgggcgacagagtgagactgcctcaaaaaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcacatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagacagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgaatacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctgtgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaaggtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacacttcctttcacgtttgtaaactagttatagatttggtacatgtagtcagtcactgtgctaaattctccttaagaattacgtctcttttttgaaaaactaacttttaaaatagacattattattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccatttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttgcaagagtccaatgctgcataatattaataaacttaattttcttaaattttcttctctggcagagaccataagcagtatgatatttagtcatgctaggataagacctgagtagaaattgtactagctatccagctcgtttgttaatttacttttgatgaggcagagaacggtcatttaaccagcttttgttcagtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaatattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgatgagtgggttgggattaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatatgctgtgtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtacgatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaacaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtaaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacattctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatataggtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacgctccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacatacaggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatgcagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcaaactgcctggcatggtgcgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaggctactcctccataaatagaaaagatctcttctccaacacatcaaaaacattatttttaataggaaaataacaaataaagaacaggttaaaaggtagaagtttctgtttccccaatacagttttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaatggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccgtggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcagcagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggtaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcatttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggatatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacgcggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtgctcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatcgttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctttggcttttccacattaaatttctcctcttggtttatttttcagagtactctatgacctacctcatcctatgtagcacactgtatctcccactgtcctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgtttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccctgccttcctccctcccctctctccctccctccctcccttgtccctcttgcctgaacttcatatcagtgtgtcttgaatatttgaaaaatatttataggaaagtgaatgaaacctatcctaaatggagaagtagatggcaaaaaagggtattagagcttggcttttcaattgtaattgtagccatgacctaatttttggtaatctaataggcccatataatctctgcttggtgttagaagggaagacctttcaccttttgtgttttcttcctaatgtcatgcaaagtgctagagctttggagcaaaatgtttgatttccaaattccaattcttccatttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtttcaatgagccaaggttgcagtgagtgccattgcgctctagtctgggcaacaagagcaaaacccggtctataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggtgttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgctttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgaggctctcatcagaaactgtctggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctctttccataaaatgatatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacatggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagaaggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacagttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagaaatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccgtccgtccttccttccttccttccttccttccttccttccttccttccttccttcctctctctctcttctttctttctctttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaggtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttggagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatctgaaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggttgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttgtgtgaacctgtccatgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccaagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgcgcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaagaaaacagaggactattatgttactatttcctaaataaagaccaatatgataaattccttatattcagtgagaggaaagaagttgcttaccgaatgtactgatatatgcttccttttttcagaaaacaacaacatcaaccaaaacacctgtataattattacatgaatttttttttttttttttttttttgatatggagtttcagtcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatgtcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgggccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttaaaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtaggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaatattggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttatggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacacacacagacacacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttaattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatatgtgtgtgtgtgtgtgtgtgtgtgtggtatattatctatttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgtgtttttttttgttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaataactaccataatttaaaaatgcaaatgtagcaatgcactaaaaaatacctttagcttattttttgttaagaaacaagtgttttgcataatcagactttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctcctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaacggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggctttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagaacccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaacatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagacacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcgtaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgtaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggtcgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtggttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcacagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaataacaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaaattaaaaactattacattttttctccctcccttcctttctactgtttccctcctctcctctctttggtttccttccttcctttgttccttcgttccttcgttccttccttccttccttctgtccttcccttccctccctccctccttcctcccctcccctccccttccttcttctttcttgccctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcacttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgcttttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactctcattgggggttgggggggttgggggtgggctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctacttgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaactaggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgtaatatgtgacagttccctgggagtttctcccctcctcgtaggtatttttagcaaaatagtccttaaacattgttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttacaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgattttctgtccttttatatttcctccttccctctgagggttcacataggagcctccacagccagaggattactttcagaattggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaacgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcattttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcactggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaattccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatatacacacacatatacatatacacacacacacatatatatagcattcttaatctcatatatatataatatatatataatatatatatattatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggtttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctcttggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcattttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagctctctttggagatgagaagatttttctcaactttattatgaattccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttggtctgtatatcttgtttttcatgccagtaccatactgttttgattactgtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatatcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctaccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaccatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcaataccagtaccatgttgttttggttactgtagccttgtagtatagtttgaagtcaggtagcatgatgcctccagctttgttctttttgcttgggattgccttgtctgtacaggctctttttcatttctatgggttttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaaaaaaagagagagctaacatcttcactttttaaggaaatagacattgcccccatgattgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatactttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcgaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttccctttccctttccctttccctttcccttcccttcccttctccttctccttctccttccttccttttccttccttccttccttccttccttccttctctctctttctctcttctttggtgtgctgagaataatctgcagacagtgactctacagataagattgcaaatattttcccttccttcattccttccttctttcctcccttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaataaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcattgtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagaccccatgttgaagaataagatacatatgctgatgtctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaacctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccatttctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggattgccattaaaataattttgtgcagcagcactgtgaggactcagaatccagaagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcaggtgcggtggctcacacttgtaatcccagcactttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgtaggagtcaggttgcctataaaggcaaggatgtgcatacagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacaatctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggtttttttttattattatataaagccttgcagtgagtcatagaagaaatgcactggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaaaggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataattcataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagatcctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccatttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagtcgtcttgagacaataggttgaagctttcactacatgttcttttagcaaaaaattataaagcatagaggttgagatgggctctggaatcagactacaaagattctgatcttactgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatctctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacacaccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgttaaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcagctcttaccagtgacttcagtgcttccttatacaaggtgcaagcggtgctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggcattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcagatatgtgtcatcttaatattcctattaaccttagaactttgtgactgtgttgggattacttgacatatttgtttatcaatcaacacagtgacagtgacaacgaatgagtaaccagtgttttgtttttgaaacatttgaagaagtgttccatatttctgaagttattagtttagtttaggttagtttagtttagtttagttttaacgacagagtcttgctctgttgcccaggctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacatcatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttgaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactcttggtgttgtacatgttgtgggctttgatgagtgtgtagcatttatttcccgtcatagaatcatgcggaatactttcactgcccctaagaattatccttgctctgcctattattactttctcccccaaccccggtaacccctgaaatttttactggcttcatagttttgccttatcagaatgtcttatagttgggaccctacaatatgcagcctttccatattgccattttactgaataatatacattcaaggttcatccatgtcttctcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttttgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccttcttcttcttcttcttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttggtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggaacagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccagcatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaagcaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacattatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgatgtgaaaacttagcttgtccagccaaactggaggaaggagaggcgggacttattggagtaactgaaaagagaaaaattggaatatgagcagtaccaatactcagtctcttaaggaagggtagagtccctttctttctgtctctgtaatttttttcttttttgtttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcaattggttttgttaacactgctgcaccgaagctctagctgaattcacataatctcatgattttagtaaaggtaacaaaggaaaacgattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctcccacagcattagccttagttatgagtataatacaaaagaagaggaccagccctgctggaaggtaaatgaaaagatggaggaattgaacgattacataacagctgttcagacttgtggtactgattagagtcatttgtagagatgaagcagtgtgtcaagccagtgtgggctagggtatactgggaagttctcacagacagaatgaagtgggttgcggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgtgtgtgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaaatatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatggcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttccctttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcatcttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtaacaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatacgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaatactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcagacatatggagtttcaaactaacactgtggtaattgttgtgtgtctaaacaagtgacaacggggctgggcagcaaaactagacatgggagaagccaactgatccattgagctgtcccagcaagagttagtgggattatgatttatgaaagacctgtgtggacaaggtagtttggaggaactgaatggagggagtgaattaattagaagaatgagacaggactagccacaaacttctcctagaagtttaaactattttaaaaataagagttgtggctcatcaaaaaagtagtgttttcaaaaaacacagccccttcacttaaatgatacgcacagtccagatagactgcaaaacttaatgtttagaagctaacaactttttaaaaactttattgatctgatctgtactgagaacagattttctctgtgctttataataaaacataaagatcaatcacaaaataatttatcaataaattttaaaacaaaaattttaaagtgtatgtaaatatcatataaaattaagaaaaaatatgtaagaataatatttgcaatgactatgataagcaaagggttaacaactgtatgaaaattttcatgcaaatacaaatatcccaacagagaaagacaaggaatgtaaataattcttaagtagataaatacaaatggatatttaacttaaaaaaaattttattcacattagtatgaaaagaaaatttaaataattgaaatctagtttttcacttatgaaattagcaaagatttaggaaaagaaactactgtcatttgctgctggtaagaccgtaaattggcccaaaacttttagaaagttattttacaatatttctcaagaactttaaatgtctcatatctgtcaatccagacagatagatggatggatggatggatggataaatatcagatggatggatggatggatggatggatttatcagtaatagatacatagatggatagatagatagatacatagacatctatagagatatatgtttctatataaatatatatctatattatcctaaagaaatatatatttgaacaaaatctatttatgaaaatgttcactaatgcaaaacttataatggcaaatagaaagggaatctgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtacttcccaataatcagattacatgtgattttattttcccccctaattttccttaattttcaagttccgtacaatgaacatgtgttattttcataagtataaaagacttttttataaaaagaaatatatagaactaattagccaaataggaaagtttctaagaacaagggaagaaatttgtgaatggagtggtgaagagatccttggactgagagctgggcaatgtggatactaacactggctctgtcacaaagaaacaaggagacttattgaggttctctcttctggctcaaagattttatgagccagtaatttatcaaagagcccatcctagtgtacccatgggcctgtcaaccctggtagacaggttagtagcccagatgaaatttcccgtggatgaattttagaactccgctccattgatcacccttttttgttgttgttgttcttttactcttctggaagagagctaagaaacttctgataccatccccctttcccactcgccctcagttgtgagatggaggcagcaaatattcagtgtgttctttttggtcttaagtagttctagactcagataccacctcagcaccaggctgagtttgggctggctttggctacggtttgctgctgaatgtatcagtgatggacttttgaatgtttaatagccttagggaatgtggcagtgtcccctacatagagaactgtagattctttagtccaccatttccaaccctgtgatttagattgtcattataagcatcacaggatgccctgagttgagaaaaatctgtgctgtttaaatggtctttaagcagcctttcctttctcctctttctcagctctattctgcttaggatatggcttatgccacttaatcaacatgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgcgaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctctttaatttactgtggttatattatatatgtgcaatggatccctattttcaaacatagtcgtttgataaagtgtgggctgcttttcatcacgaatgtaaaaagtctcttagttgctacacccagcaactaagtgtcctttaattcttaactttgaatacttaattggatccctggtgctatgtgtatttgatttttgttgtgaaagttgcattcactgtgtccctttatttgacatcagcaagatgtaatttctataaaccaattaatgatgcacctttcaactcttactatgagaatattagctggtgtaaatatcggactccttgtgaaggatgactcgctatctgattggtctttaaaaaaatactttaggaaataatggcttgcccctgcatataccaatttgaagtctttctaatatcagccattagctgggatccacatggagtacatagacaaatgaccatagtttctactgtaaaaatgcctcaagatcttgtaggtgagattaggcaattagataaatgcctatagcacaaaatgaattaacatgattgcttgaaaagaattaatttctgtaataatttgaagaaggaagaagttatgtatgctttggggggtatacagaaaggctttataaacaaccctatgaaaaaatggaccacagttttaaacgggcaatccacagaagggaaacactgcaatattcattggaaaaagaaaaggaaggaagggagtgaccaagagaagaaacaagaaggaaaggactgaaatcttgtttgcctttttggagaagatagcatttgaaatgggccttggataataaggtgtgattgtcgttggtggaaatgaattgcatccagaatgcagaaataactcaagcaaaggcatagagattggaaaacatggggcaggtagaaaacaagtccagagtctttgctgcttcttagaagatgtataagggttttattttatagttttataatgaagggcttttaatttcaagtgatgggtcagtgtataattccttaggagataaaattccagggaaaaggaggaggggttataagataaatctagaaatctaactcataaaaattagttcccttccagggagttagttactccaaaaatatccttgataagctaactctgcatggatataactgtgttatctgtgagctggctacagacaagaatttacaattgtctgtagttgcagtctttgagctgcagtcattcaatctctgtctactgctaaaagccagagtttggaaagagcccttatgcatgcttgataatgacacaatttgactgagaatactgccattttataataatctctgaaagttacttccttggtctactgaatctcatattttgtgaagttaaatgaccaatgactgtcattcattggccatgattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagattacttcatagtgaaacacttaagtttgattcttatgagttgcaaaatgattttccaccaggaaaaataaagaatatgggttccatcaaaagtcaggcatgaattctcatctcctgataaaatgtgaaatatctttgctgatcctgtgcctattctcagtttccatgaccatgcacaattattatttttagcaaataagcaaatttgaggcaaaaacattaatttgataagatatctgcaaatgcctttctggaggagaaaataaatttaaaaagcatcagtgtgtttcactgatatgcacaatcccccacttcttataagaaattaaaacactagtttttaatatcttcagagagaaaatgagtaaaggaagcacagtattttccgaaacgtgttatttaaactaaaaccatgaaatttatgaaaaaaaaaaaaagtagacccttccttgatacacttggtcccaccgaggttcaaagtttcctttgaattggggggggaagggagattctgtaatttaagttttaaacttctgtctttgtatctatccttgtgctggtactccgctatcttggttgctatggttttagagcaaatcttcatatcaggtggtctaagttctccaactttgttcctcttttccaaaattagttgaactattgtgcatcctttatatttccatatatattttagatgtggcttgtcaatttataccaataaaggattctgttgtacatgtaaaccaaattagggagaactgacactttaacaatattgtctttcaatgcatgaacatggtatatctctccctttacttcatttttttttttttggttctctcagcagtgtttttaattattattgtaaaggccttgcacatattatggaacaaacacatattatggaacaaataaatgtaaaagctaaatctataaaacttttccaagaaaagaaaagaattcttacaaccttagataggcaaatatttcttaaggagtatacaaaaaaccccacaaaccataaagttaaaaatgataaatttgattttataaaaactctaaaacttgttttttaaaagacaccataacaaatgaaatagcaagtcccatacagggagaaaatatgtgtacagtatgtgtatatgacaaagattttatgccagaatatagaaataattattaaaactcaagaagaagacaaagaatgcaatttaaaaacaggcaacagatttgaaaataggcaatagatttgaacaggtacttctctaagaaaatacacaaataaccaataagcaaatgaaaaatgctcaatatatgtagtcattaaagaaacaaaataaaactctgtaaggtacctccatacattgatgagagtggctaagactaacaataccaagcattagctaaaagacagagcaattgaaattctcatacactgcagttgaggatgtaacatggtactgccactttggaaaacagtttggtagtgtcttaaaaataaaacgtgttcaacatatgacccagcaattctcctccttgacattgacccaagtgaaatgaaaccttttttttacacaaaggcttgtacacaaatgttcatagcaactatatttataatggccaaaaactggaaacaacccaaatgttcattaacaggtgaaaggacaaattatgctatatttatacaatgaaagatgactcatcggtaataaataaatgatctgctaatatgcacaaatacatgaaaaaaatcttaaaaatatgatgctgaataaaaggaaccagagctacctccacccctaaaaaagactgcctaccttagaattatatatttacaaaatcctggaaaagacaaaactaatctatactgacacaaagcaatcagtggtttgctgaggctgggagtggggaaaggattgattataatggggactgacaaatagggaactttttggggtgatggaaatgttccagatcctggtaatggaggcagttacaaagtcttataaatgtattgaaattcatcaaagtgtacagttaaaatggttttatttattgcatttagattatacctcaacaaaggtggttttaataaataaacaagaaaaagtgtttttcaccaattggtttgaaattcggccaaggcatatttgagcgagggctgtcagccttgtatttgttgcaagtcacagtgagtatgtcctaatggatcctctacaaggtccaggttaggtttctttaaaggatggcaagaacctgaaacagtgtgagtgcagagaacagtgaaacagtgtgtgtacatagtgctttgatttttgtgcattttttggtcctaatattttaaagtttgctgaaccatacctcatagaacatttacctgctttttctgagggaaatatctttatagaacttttccaaagcattctgcatagattttattttaagaaattaaaacattttatttgtattaatttacataataattggttaactcacataattacaatgacaagatcatacagtaggagcagacttgggatcaaatgcagctgactctaatagcaggtgtagcaggaggcacacagctgaggggacatttgagacgaaattgaggccaggttccacttcacattgtactagggttaagcgtgtccacccagaggaagagaatccttaggcctaaaagagcaaaagtgtacagacatactcaagagtaagagagtagccaggaacaccagccaagccataaactccagtctgtgtgtgttaacagataaaattaagagggtaatctagggagtctattgctaaatgaagggcacattaagtctcaacagtattcctatgatcaatcaagcaaccaatgaagtgtacaagcagaagtgatttgtcatggaatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtggtaagaggccagttttcccatcctcatttactctaaatttgattcatagattattgagcctcagatatctgtttgccatctggtctggtcagtctggtttggcatgcgtcttctttctctttagagtttgatgacgttttaggctgtgaggggcatttgcattgtagtagaaattggatgatgtcagacttgctttatcacactttctcaataatctcttttggtgagtttgatattctacttacagctgctaaagctccttataaccatacgcacaaacatacacttccatatagtcatacatactcacaaacatatatacacagccatttacttacacacgtgtacacaaaggtgtatatccacacacttacatgcacaatgagagatgcatagtaagaatttttccactacccctagtttaactggaagctgtagaaaatctgaactttattatattgatctctgggatcatccacaaaattgcccaaaatgggaatgcggaagctgtttcttacctttcattttctccacatccaatgtgtcctcttcaactgtgtattttgaaacaacctttgaatctgtccccttcccgcaactgcactgccaactgctgatatcattttttgcaaacaagtgtaatgaaaagagcatattctttaacatcaagcaaactaaggtgcaaattttagctctgcatgtattcattgtgctatcttggacaagttatttaactatcctgagcctccttgtcttaatgtgcagatagaagaagataatgcctacctgataggtggcataggaaaaggtcaaaaacattattttctactcccattgctccccttgcctgaaacattataatggccaaacaactggcctcccaacctcctttcccctcttcagtttttcctctacattatagctagagattttgctaaaatgtatatatggtcatcccattttttacttgaaactggtatcttcctgcctataaaacacattttgtttcttagtctcacataggaaatcctttttagtctgtcttgggcccaggactccagtccgattttcctcccattcctacctgccctcttggttttgaatgttccacacaacttcattcctttctctgttaattggcttttcctttacttagaatgctttcccccttcctgctttttagggagaacagggtaaactgttctccctatccttcattgagtctcctttcttttttctaaagttttttcttatcagcatccctcccccaatttgagctcattttctagaaagaattaatagctttcttatatgactctcaagatatttctgtgtggttctctaacagccttcatttattttatatggtaattatagatgtccatttgttctagggaaggcaggtgtcaggtcttactcatctttatattcctggtttgacatacagtgcctgatgtctagtaagcacttgatatctgtttattttaatgtttatgccctacattatctatcacaagtattaaagattgataggtgctctgtaaatgttaaattgagttaattattttcaatcttacaggaagttacataagtcattcctgtattcatttgtgaattttcgacatcctatattaagagttgcacttagaatgtgagttccatgagggcaacagcacttctgtcttactgctctgtctgctatgttggcccataattaaccactcagtaagccttttgtgaaaacaacctcaatgagtcttctacctcaagtcttttgaataggaatggatttaaagctgacccctaatacatctttcaaactttaagtcagtaaattttttacaaacttttttaagttgataaatccctcagaaattattctgaggaagctgatgggatagaaatgaaacagactaaggggctccaggcaatcaccactccccttcgttctccttcctctgttggtggggatcaatagagcaggatcctcaaaactgtggagttctttggagcatactttgaaagcctctaattctattccacgctctaatttccaaaagagggaactgaggcccgtggtggttaaatgccctttccgaggttacacagctatacatggtagagccgacccatgtcttctgactctcatcccgttgcacttacaactagcctgcatgttccccttttcccatatcgcatggatagcatcttacgcatctaagtttttttctttaataatgatcttctcttttctttaagagacaccatcactccgagttgtaccacttgcaccaggctaaattattcctcagtgtttacccctttcagatatttatagaccatcattatggcactccctagtcacctgtcagcttcctaatatgtacatatatggtttctttaatctttctgtacagtcggcttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgtaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttactgagcgtatccatttttatgcagtttctgtggacttacatggtttctgggagctccctataagccttagtaagggaaagctcttgacttatctcactagttattagggatttggatatatgtttactaaatgtgataatctaagtatggaaactacattagtacaagaggaatcacccagaaatactctactggcataaataaaacattacctattgcccagttttctcatttgtttcattttgtaacttttataatgtgtcaataagtttgaagtcttgaagggctgcccagaaaccaccacagagtggattttccttaccctcaatctgccttcatcaaaatttagtttgtgtgtttatcctataaaatttatctcataataaaaactgaagactaggacggtccttagaaaaacacttgattcggtgtatttattttataaaagggagtcacagagagaaaatgtggccagctcaggtacatggcttcctaggcaatgttccatttcgcaaaactttcattggtccagaaagtgtaccttcattcccaaccaaatccttcctataatgctttccatgcctttcttctgtggctctctctgatgatctcacaggtctataagctcttacaggtagaaatatgatttcttgctgtgttcttattataaagcattgccatgcaactgagaagtaatgagagccagtggattttattagaatggaattttaacttttctactttaaaacccagtgattctgctagtctggaggtagcaaagaaggatgactattttctctctcacacaaagtaagattctgaaggggcttattctctgaatgaaaaacgagaggagaaaagtaagaaccttctaatgttttattcaaatgttaacaaagaaatttgagaagcatgtttccttaaaattgacaccatttttatcccaaacattctggtaagtgatagcagatgactgtgcaagcttctatggagagagagagaggaatttttccaggagcatagtcccagtgggaagtattacctaaaagtaatacactaatcactttcaatcttgcatatttccacatactgtgtgcacacatatgtgtattaataactgttccctagacgtcacttcagcgctcagacagcttagtgttgctatgcgaatgctggagatggaatcagatgcagactacagtttagcaatgagaattcttcagagatacaagaatggaaatggccttaggtcctgcctcatgggtctccctctgagctccagtgtaacatcgggtgtcaagtatttgtggccccatctgcccactccactgagaatctaaatggcattgccagtatttgtgaggtactcatatcttaaaagtcagtgtactcaaatcagtcttgcattctaccttgtggattttgcatggaaattttttagaatgtcattgctgatggaagccccagatatataagtacatctgctccatcgtactggtgatttttatagatattcataagaaaatttattttacagcagtttattttagaggaattctttgcattttatttgtatgtgtgtatacttattttactggcaggatacacacacatgtatatacacacacacacatacatatatacacatacatacatatatatatgaatgtatgtttgtatcctgtcagtaatactttgaggtacctagggctgagattactatttctcttccacctatggctcaaatgggtaaaatagcttactcaaagtcacagttcatacatgtggtgcagcttgaatcaaaactcaattcttctatccacagatttaccactacttgagtagtctgtggtgtttaaaaaaaataataaacaacaggccgggcacagcggctcacacctgtaatcccagcactttgggaggctgaggcaggtggatcacaaggtcaggagtttgagatcagcctggctaacatagtgaaaccccgtttctactaaaaatacaaaaaattagctgggcatggtgacgtgcgcctgtaatcccagctactcgggaggctgaggcaggagaatcacttgaacccgggaggcagaggttgctgtgagccaagattgtgccgttgcactccagcttgggcaacaagagcaaaactctgtctcaaagtaataataataataagacgaagaagtaacaaagccaaactggaaagtttctgttaaatgaatgttctagataataccaacgtataaagcaatcattttataccagctatggtcaaacagggaccagagccttgacttttttttgcctcaacacagctctgcagaacccactcagtaccccatgtcctactgccattcctttggtttccagaacattgagatgtacaaatccaaaacaccacagtgtttcagagagaaatggcatgactctactggttgcaattgtaatggagttcaccttgttctggagtcatacagaagccatgttgtagacttagtgtcccacgcaatactcctaattacaatgaaaatctactgttaggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttatagagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatggcctgatcaacactttttaataaaatcacaatatctactgctgaattttggagggaaccaattcaaatcatagcacacatcttttctaaaatggaaagggtaatatgatcattggagaaatactcattcctttgcatattggtttactatccaagccaggtgtggtggttcacacttgtaattccagcactttgggaggccgagatgggtggatcacctgatgtcaggagtttgagactagcctggccaacatggtgaaaccccatctctactacaaatatcaaaaaattagccagccatggtggcacacacctgtaatcccagctactcaggaggctggggccagagaattgcttgaacctgggaggcagaggttgcagtgagccaagatcgcaccactgcactccaacctgggcaaccgagtgagactccatctcaaaaaataaaaaaaaaagtttactatccagagaatcttgtccaggttaacactcttttttgtctgctttcttcttttgtgaaacaagaaggtaagagggacactggagaaaacctaatgttctttacaaaatgagtcatagttctccatctgcaaactgtggctcccatttatgtcttggtgtcaatatgactattacatgttatgtacatggattccacctcatttgcaacatagtcttctgcctgagctctgtttgttggatctgatctaactttacatggtcttaagtcacacattgaactcttaagttctgtaggcctctaagcctttttaagttttagtattttcatcgttaaaatgagagtgattataacccttgctttgctgcctccaaatattattgagggatcaaatgcattgataaataagataaagcactagacaaatataagggatgcttgatgacttcacagagggaagattattctgttgctggctgctgaaatacagtagctttagaaaaacccctttgggttcccttattatcaggtttggtctcaaataaccagaataaatttggagatttcctaccacaaaagctaaaagtacctgggcagatttaccctttgagtggacctaagggaaatgcagattcccacgggagagatcacggagcagattcaaaccataaggcaaaaataattgttgcaatagcggttctaactgtactagtaaatattgatttttctgttagcagatcaatcatgaaatgaattctaaatatagaagactggttaaaaaattaagacggagaatgtgaaaatgtccatgtgtaaaaattaacttaaagagaaatcttgctttggccaaaagaaatactactgtttctgtcaggaatgttctgtgatttaatcaagtttcctgcctggccagataattttaggaattgtggacttttaaagtagtaagtcagtttagaaaactggttaagtggacagatgtaaagtcagactgcctaagccccaattccagcttcaatatttaactctgtggttgtgggcaaggcacataatctctttatgctgccttttcatcaactgttatggagataatgatagaacctacatcatagagttgttggggtgactacatgagataatacaattaaatacttaacacctggtccataaaaagcgctgaataaatattgactattatcatcaccccggggtctacaaatttttgtaggattaggattaggattgaaatttctaccgaaaaattccatcagtaaaatattgataaatataaatcttaaccaactgcctcagagacatagggacctctattttccactcattgactgtcatctttagagaacagtccaaagcatgtgcctttctgttctagttgttatgagctctttattttgaagttgaactatatacttcctatagtttaaaggagaaagaagtaggtctcatgctggacaccttctagatgttacctcctccgaatttcatagccaagtatttaaggcagttatgatcatctccctcttagagaagcctagaaaaggttactgcagtgcttgacagcaaatagaaactcaccaagtgcatttgttgagggattgacagaatggctggataagtgactcaactaagaccacttatctagtgagtgcgtctactcagctgcttgttttgaagacaaggaaattcgggctcagaaaatttaggaaacttgtctaggctgccaatagctagtaacaaaggcaagaattgcatatctgattttctttacaccatgttacatctaactgttcaaaagataaccatgtattatactcgaaaatgcaaaacagggttgttttttgttttgtttgttgtggtggtggtgatggtatttttgttttgtttttgctacttttcctgagagtggaagttgttatcaaaaagttactgtcatgactactatgtgtatagatgctattagtttcatcaaggttgggaatagggtatatgttgcccaactttctgcccctctccgcctcatattaaagttccagtttcctagaatatatctcctgggagatttggcactagccatcactgcattccaataccccgggacaaactactcttggtggaacacagaagcatacagtccttgttacagcagtggttctcaaactcacattcctgatggaaagctagagttgaagggtcaacacccaagagctgcagtggaggaccatcacctgtcctgattcgccacctgtggtagatcatgactttcactaagatcccctgaggcttgtggggatggagaagtgatgctggactggcccttcctctttccctgcaggtgttaatgggttctgctcctaaacaatactgatataggtcagagttatgattgaattgtatacatagaaacatgtgctgattgagaaaatgggctttacaagtcagacctggttccagtctcagccacactacattctgcctttgagactttggccaggtgatggaacatcaggtttcttatctaaaaaggagaataattggttggtaggactaaatgaaaaaatgtatgtgaaatgcttaggacagtgctgagcacagataaaaatgcacaataattttctattttttgttagtttccttcacaatacatatatttacatcagcgaaacatgcttgcttttgcaaccttctgtgggactccccctcctaatttaccacctcacctgaaggtctaagctaagcaaatctctgtctataaatgaatcacatcgtggttagactttataacaacttccccttgccaggagatcactcagccttcacttcatctcatctggtttgctgcccaggcctttatccactcattcctgaactcctctccctgacaaccttggggttttggcttgttgtgtgcgtgtgtgtgtgtgtgtgtgtgtgtgtgtgtgtgtgttttgttttttgtttttttttactttaccttaatttctctttttggactaagatgttaaaatgtttcttaatgtgactgtctccgaaactgttttgtgtctaccactcatcctagtggcagtcattgatccttttcttgttgcgagtgtttgagtgtgggtgtgtgtgagtgtgtatatgtatttgtagagggaaaaacaagagagagggaaacagacattggagccacctttcccccactagccacgtacctgttgaaccttcaagcctctctatagaatcagatatacacaagcacagtgacagaactacatgtgtcctacagtccagcttttaagatatgataaaaactcttgtattcacagagctaaatggcaataaccataggagattgcatattgctacattatgtaaagacagagtcccaagaaaatagtgagaactcagtttgatgtatgatgtgatatgtgatatcttactttacatggctaacagttgacattctttgtggattctatattgtctaaggctacagaagagccatatgataaattcatcggcaacccaaaagaagcctgttctatcgcagtgcttccaattaatataagtaaaccactttctctggctcaatgctaccaaaatattttatgagaaaatttagctgattctgctcatgtatattttcaatggatggaaagccattgcaaacttttcaaactaaaatataaagatagcattagggagaatactctctctggtgaaaaacaacatgtattatgatgcgttaggaatttctttttttcagccaactcgtggttgagcagtctgtccccaaactgttttgcatgcggacgaaacctgtttgggcgatacttgtcagcttttcttctgacaagcaggacagaaataggcacccccagaacactgagtttgacttgactcaacatagaatcacctggagagttttaaaagtttctctcctgtaatatcccacctccagaccaatgaaatcagaatctttggagttgggaaccagggatcaatatttttttttttaagtttcccagatgattgcaatatacaggcaagattgagagtcactgtcctagagtataagcagtttaagaaacaagttgtctattattacatgcatcaatactacagagtccatgaaataaaagctttggtgataagaaaatgccaccatcctagagccttcagttaacatcatatgggcctgtcatataaagaatgcaaactcattctgttatctttttgggccttcagtggaagataatttttaaatcagcttaatggaaactgtgcttcaggaaaataacttcagtagccatatgtaggataaactggagcaggttttgtttctaggaatatgttgccatcatttcactacccttatataatcttattgattcaacttttagaaccaagactttttgcagaatatatcgaagaatgtgcttaatgggaatgctgatatatcatacaattggcatatagagcttcagttcattatcatatttaaaggtacaatattaattttgcttgtgcttaaaatgtctattataattcaagtagcaaggaagacataaagaaaaatgtgacctggctttacatctgcacatatttaatactttacatttgatggtgaataatgggaaagtttgggagtatgtcatgctcagtcaccatgcatcaactcccaaaatggctgtggacagctttggtcctgcctcaaaacaagcactgcttgcaaaagagggtctgtggcttatttttatcagttgtgtggtgatcacaggaaaaacattttaaataaaaagtttattttgccatcatgaaagaaacaaattcatattaccaaaagagaaaataaatatgacaacccagcctggtgcagtggttcatgactataatcccggcacctcaggaggccaaggttggagggttgcatgatcccaggagcttgagaccagcctgggaagcacagcaagaccctatctgtacaggaaaatattaaaaattagctgggcttggtggcgtgtgcctatagtcccagctactggtggcaagggctgagggaggaggatcacttgagcccaggagttcaagggtgtagtgaaccatgatcgcactactgccctccagcctgggcaacagagtgagatcctgtcacaaaaaaaaaaaaaaaaaaaaaaaaaaaaaaaaaaaaaaaaaaaaaaaaaaaaaaaacaaagaaaagaaaacccatatcacgctatgccacttctcttgttcaacctgtagatttccctggaatgccactattcacccatgccatccccaaaaatgacttgttaaaattctaactcttcagattagctccattattaagacttctgtaaagtctttctgttggtaagaggaggtaaatcagagatatcagaacaatcaggaagccattgcaatagcctttgaaaggaagggtgattaggtagtaggcatgtggtggaaagcaggcatttctgacacattgctgaggttgctatagatgggagagcagaggtgaaggataagaagaattgttggctgaatctagagtcagtacaaagcaatatataaaataagtaataatatataaacaccatttttggttttgtttggaaatcttaattcactgacaaagttccccatcggctgccggccctctgtcatcggatcttttgattgactgactgctcagcattggcagcaagctcttcacaccagccctgggtctgagctaatcagctgtgtttccttcatgctctgatgccttgaagtttggtactattctcctggtttctcttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctagaggaatattctccaaagcataaagtagaagatcattccttaggaatacaatacagtccatctgttttcatagctgagaaggcaattccgtgtcatgccatcatggagccactgcagtgttttggtatccaagccatagtcactcattctctccgtgagggaaaactagaatgtcttttcctcttccacctttacctttcaaaattccatccttgaaggttcggctcaaatgcttctttctccacacaacctttcctgagcccctgtgagtgtggttttccttccacattccatagcactttcttctaagacgtgttacatgctttgccatgtgactattgcatgtaggttgtcttgactgtgagaggcactgacatcgtgacatcgtcgaattcatttttgtatatcacacagaaggagaacatagtcgtgggcaagagtagatatttgaggttgaatagatggaccatttcaaagcttatcttttcagcctgacctttaaggctttgctctggccgttccctctaaatcagtgattgaagtttgctcccagatcctcatgagtagctatcaaactctccataagccatgtaggctcaggttcttggattccaggtattacacttcgggcatcatagtctgaatcaaaattgctacttttagctgcttagtagactgccattaccaatagtttaatgagaactacttttttaggggacggggggaagtgtggtccacagatccctgatagcccttcgtgtactatgtagtgaatctgcttgacatctagaaaagggaagagtaatatagaaaaagaattttgttgacctgcctgcatttaacaaatgtaaaatgtaaaattacagctttcacaggaatctaatatgcttttaataatcatatggattggtaatccatttactcctaatccctaattcgttttctgcaatgaaatgttgtcaaagggtggcatgaagctgttagaatttaagcatgattttcaaacatagcacattttttttgtggttttgtttttttggttttttttttttttttttttcagaataatttcaaaaatagtgccatatgaaatagttttgttactgttggcaggaaagtccaaaatgttatctcataataaaaacaggtacaagttcagtcttggataaaaacttttgaagtctgccacaaacaaatactatacaaaattttttcatcaaatgtcaagactgtggtatcaagactttataatgatatcaactgtagtggtgacagcttagtttccaatactttaactctttttccagcacttcatatttctttttggtttgagatgaagtctcgctctgtcacccagctggagtgcagtggcgccatctcagctcactgcaacctctgcctcccgggttcaagcgattctcctgcctcagcctcctgagtagctgtggttacaggcacacaccaccacgcccagctattttttgtatttttcatagagatggggtttcaccatgttgaccaggctggtcttgaactcctgacctcaggtgatccacccacctcggcctcccaaagtgctgggattgaagacatgagccactgcacccagccttcatatttcttattccttaggaaaaaaactaagatgtatactttgggttatatttaaagtcacattcaaatcccacaacaggatataaagaaatacttttcagggccaaatacaactggagaggattagaaataaatttacctttttttctctcacgttgaaacatctagccctcccatgtttgagtgtgaaatggctgtcaatccaatgtgatggagtgctgaaagccgtcttcagtgagaagtctctccataatgctccctaacatcagatccatgttaatcctgatgcacagaactgggaataggtaatatagcatagtgtttaagagcacagatgctgaagttagactgcttaggctggaatttagttaaccatttgtgtgactcagtttcctcatctgtgaaataggcataataacagtacctgcatatagactgttgtgaatatgaaatgagttaatatatctaaagcccctagaaaaagtctgacatatgtgaagcactacatttgctataccttatctatcaaagcctacagcttctggctaacattcccagtgttctataattattagatagaattttttttaacttagtagaaacaaagactaagaagggaaactagatgtggacgtgacgtctagctcaagattcccatgatggagccacatagagatatggatggcaaccagcataatgcctctcactgacataactatttgtctgaatttatattttattgttattatttaaagcttactgcaaattttaaaaactgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggtaagcagttagaatgaggaagcactatggctcagtaggagaaagaaccttttagccatcaaagcgatctagaaattaaaggactgccttgggatctgcctgtcactgagagctggctgcagaggttttacaatcagggcttttgtaaaaggaactaaaatttgagtttggacccaattatcttacattctaactggatgtgtagaatctccaagaagaaagactcttctgtactgttttatagattttgccttccactccaaacatcctgagtcatgttccttttatacttgcatgtgagatgagagtcagagcactgacctcaaagccagcgaccgggttctactgttcctttctgcaagaacttagactatgagactcaatcccctcaaccgattaatgtaaaatcccctccatgccaatcttgcagaggataggggtggctgtactggtgatcttgctggggtaatggggtaatagtactggggtaatgacggcaggagtggtggttctattgctgctgacgttatgaacctgctttctcctccactttggctttagcaggactgaagtactccttggtgtgttcttatcaaacccttttttttccaggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattgtaagttccagatttgttcctcaagcactttgcaaagatgtcttctgtggctgaatgccagtcactctagatagaatatagccatcagatctttgcttcttcctagacttcaaaatgtgtgtgtggggtgtgtgtgtgtgtgtgtgtgtgtgtgcgtgcgcgcatgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttacatgtgcagtgaaattcactgggctttaggaaattattataacctttcagacatactcctcgcatttttacatgtttgcttgcttttctgagtgcgtaacaaaactggagaaggtctaatctgattaaataataggtttctacagtgtgtgggctcaagtttctatctccattccaggcatagtatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactatgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgttcatatagttttgcattgttagtattcatttttagatttttatctgtttagttttacatttagattacacacttcattttaaaaccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagcacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatataagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagttttagaaaaagaattgctgttttattcctagcattaccaaggagtctgggcctagggacagagtgcatcagaaattctcagcaaaagtctatttatgaagtggcagccaaggatcctcccccaaaccagtgcttttattcccagtggatggactccaggtcctaactctctgacagcagaaggtggtacagacatttttactagagttgaaatccaaatgactaaagggcctctggaaataggaggccaactccacaggaggctaaacactttaaggtacctgaaacttggcgcattagtgaccaacacactagcagccttttgctcccttatgtcatcaaatggctacagttaaaacattctaacttgtcagcctacattaagaggtagttttgtacctctgcaggaaagctgttcttttatatactcaattcttcttaataaaatgttttaaaagcacttatggccagtgctttatgtggatgttggaaaaggaagcaagagtttggactaaacctgaaaaatccacatgaactttcttcctttttttctaattgcctacgtctgctctctcacctccaaggagtgtttgtctgtgcctcttgtctctctttctgtctcacacaacacacacacacacacacacacacacacacacacacacacactttcttcttgctgttacatcatcatttcaccagaactctcctaggaaggagaaaaatggttcaagaaagagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacacccagcccatgttaaattttctacgtgaagatcctaaaagcccccaactactcagatttaaaatcaggtataattatagccttttcccagaaaattttaattgataaccacctgactcatgctttccagtatcacagaacctgaaatgctaaacttctactgatgaaaaaccataagcccttgtattttcttgagcatttgaggccttaaaaagcaaaaaaaaaaggttaaaaatatttataacaactgacattgacattaacatttgctcagtgctttaacttttatgaagcacttttcttttatcatattaccctctaattaatgatcctagaaaatagttacagttatttttgccttcatttccagtggcaagaaactgaatcttagaaagtgtcagcttgcttagttccatagagtatgagtgtcagagctaatacttgaccctgggcctctgattcccaaggccggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttgtcatgcacttcttttctgttatgtttacctgtgggtatggaaggatgtatacaaatgtaaccacacatctgtatacatgtggttacatacacacacacacaatgagatcataccttaactattggttagtaccttgcttttgttacataacagtatatcaaactttgccttctatacagtccgttttaaatattcttgaaccactgaaaaagaatatatgtcacctacatatgctttctgaaggttgattcaaggatattttccaaaaggcaaataaagtaatcaaaataatatgcacaagagatgcatagcaaataaaatggtgaaaagcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaaccttaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatagcaatgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagagcctagcaaaaaacgagatgcttaccaaatcattttataaagctagcgtgctcccaataataatacctaacctaggttacccccagaagacaattctgtgataatctaactttcataaatgcagaaatcctaagtgaaatattagcaaattgaataccacataataaaacattccagttattccatattcagtgctagaacaattaggaatcttttagcataatttgctatattgatatatcaaaattttagaaaaactagtaatctccatagatgcttttcattaaaagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcactttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgccctagtttgtttaagtcaagcatgaactcaccactcaatgtttgccagagtttggatgaatgtcagcatcaggctactgtaataatggtttaagattatttaatcccattagttatacacttcattaggctgagtgaattgttggcagtggttcagtaaacttcctcctttagagataaaaggacagaaagaaaataggaaaggagcctattcctcattttctttcatagttataattcttttttttttttttttttttttttttccgagacggggtcttgctctgtcacccaggctggagtgcagtggtgcaatctcggctcaccgcaagctccacctgccgggttcacgccattctcctgcctcagcctcccgagtagttgggactacaagcacccgccaccacgcccagctatttttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatattagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttacttttagcttcagtttcctcacacttagaatgaaaacaaacaataagagcaaaccagtttgttatatgttctcacatctgactttgtaaaacagtttgaaaacattagcgtgctcagctccaggattgtcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaaaagaaagaaagaaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttccgatctccagccttaaaatgctttcctggaacttaaccaactagatgtaaccatttctgaacatgcaaggttttcatttccacatctctcataggattgatcctcaccacaactggtattatcaagtcactggcatccttgacacactccagtactgacaggaaccccttgaagactgtgcggggtgcggggaggtcacccttttttcttttcttttcttttcttttttttgagacagagtctcactctgtagcccaggctggagtgcagtggcgccatcttggctcactgcaacctctgcctcctgggttcgcgccattctcctgcctcggcctcccgagtagctgggactacaggtgcccgccaccaagcccagctaatttttgtatttttagtagagacggggtttcaccgtgttagccaggatgatctcgatctcctgactgcagggaggtcacctttaattcgtctttgtcttttctgtagtgcttatcataataggtgaacctattgctgctctgatagtgagggggatttggggggagcctgtgtcactctagcactatgtctccccacagtcattgactcacataccctttgcttgccccttcgtgcacctaggacctgagactatgtatgtataagaaggaaggaggagaacttggctctgagagactatgaacagagtcattgctgaaatgtaaatatcaaagattgaagggaaagatgtgagagtgaagccagctgtctagcttccagccgtagaatgatcataagagctactacactcaaggtcaaacacactgactcacccatgaaaattgccaaggagtttgagtggaagttctctgatattccaatgactttgaatgggacacggtaattccttcccacagccagggcttacttaaaataagtaaatgaataaataaagtctactccctggatcttttttttgctcttgtccctgcagagtaaggggatgccagccaaggctgacatcatcattatagcaagacaggtgctttttttgaatacttcacaaggacaagggcctggtattatgtaggtcttcaaagaatatatatatatataaatttttttaattcagtctcctacatttatagtatggggaaataagacaagagcgaggaatgccttgcttgggatattgcaattggatggctgcactgaggactatttaagcaaccttaaaatcacaaacacacatctgtgatgactttttaattatatctgtcattttggaaaagatattaaacatcttcctcagaagttatttttactttacacactctttaataatgttaaaagatatttgatgcaatttatattaataaagctcatgggacgtgttagtaaaaataaaattgaatcttctaaaatatattcctttaaaaatgaatgtctataattttatgctagtttaagcaaataatctgaataaatcctgtttgtttagcataacacatgtacacgtagtttctccacaaaatggaacgcgctaaatgtgttggggcctcaggaaagaactagtggaagggggcataggaggatttgggggcaaaaggaggaatccaaaaagaaggtcttcatggaggaagagacctgtcccaatgtgtcattcggtagatctcactttctcctagtacctcatagtcattcatttttcacccccaacagacaagtggagactgatattattcccttttacaatgtaacaaaatcaaagcttagaaaaccagggggtttggaaaataaggaatttgtgtaggattaaaatagaactttgagctcctggactctgaatcttagcttctaccttgcacttaaataaatttatgctaacagatgtcctgtcatcagataggacttttttttttctttttaatgtcggcaagtctcattgttacagctctctggtctgcccagtttggttacacctgttttgagattccttgcctatacccttccaactgaagacaagcacttcctactgtacttacagaactttcatctatgtcttggtttaatcttttgcctttgttttaaccgtttaccacttctgctttatattggtaggtaatcttacccccaaatacatagactatgagctccttaggagcaaactcattttttttttcctgttgttctttgtgtctttttttccctatccacctccaaatcttactccacatttctgaaaatagcacccaaagcaatacctctcactttggggagtatttagtacattttttaaaaaatgaatgtattatacagtctggatcaccataacaaaaatacaaggactgagtgccttaaataacagagatttattttcttatagattgagaatggaagtccgagatcagggtgttagcactgtaggattctgctgaggactgtcttcctgacttgtagatagccaccctctcactgtgtccttacatggtgtgtgtggggagggagcaagcccactaagtgtcttttcttataaggtcactagtaccatcatgagggctccatccttatgacctcatctaggcttaatcacttctcaaaggccccatatacacatactatcactttggggttaaggcttcaacatataaatttataaagggactcaatttagtccatagcaataaattaggccttttgactatagatctgtaagtgcataattggcactgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgatccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggcacaagtggcaggaagccaaactgacctgagtctggctgggcagtgtctgcaggttactccagcaaagctgctggaataacgatgtgttcttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaataacgactcccaattccctgagttaccattagatggtattaagcaacttcacttaattatgtacctgttttccagttatgttaattatacatcctttagcatttaccacctgtaccaatcatttagcataataataccttatacttaaatgcaagtacccagaatacttttatagttgttttcatttgatattcacaacaatcctacaaggcaagtgttatttctagattagatatgagagaactgaggcatagagaaggtaacccatatagccaagaaactaaaacagggttctgacatccattttctaactatgcatctaggtttttttttttttttacctctgcgtctaagttgcctgcctaaatcgccttcagtccattgaaatccatccaatcaatatttactgaacatcatctgtatttcaaatattgtagtgggcattgggggtatgaaattgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttgatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaaaaaaaagatgtccttgaaaaactaaggaatgttagtgcacttatagaaattcttgcagtttggagtaatttgccacctccccttctgaaaaagtacctgatgatagtgtgcttgagagataggggtattgcagacatattccttaggtgagtaaaactgaattgtaaagtggatgctatggaccatggattatttcatttagtacgattgacagtagaaaatcaggaagggacgtgcatcagtgcgaggctgacacacagatctgaggatggcagaagctcactgaatagcacacgcaaggacccttcaaactcatcacatgtgccgtttggttccctttcaatgggtcggtcttggaatatggaggtctgctttcattttgtgccaagtaaccacgtgagcagtttacaaaagatacaaacagaaggctgctcattcatttttcaaaaagacttttttttttttgcaatggagtttgcaaagtgattttgcaatggattttgcaaaaaaaatggatgccattttttttaaataagtgtaattccaatgatgggaaatttactagctctcaaggcagcttttccttgtgttgaaatctctaaaggttaaaaagttactttttggaaagaagtctatttccttacaacatgttttcattggtccatagagaagacagctaatacatcttccacttggcagccttttaagtatttgaagaaaattctcaagtccatctgaatcttctgttttggctaacttctagttccttcatccatttccaacctaaatttgagcctaacgaacagatttcttctttcttatttaaatatatatatatatgaggaaataaaggcacagagggcttaagggagttgcccaagaacatagagctggttggatgactggaatgtaaggctgtgtggctctaaaccttgtcatttagactagaacacctatacgtcagttagcttcctgccacttcttgttttctgcctggataggactttataaagagtttggaagaagggagagttccgacgaggtacagaaatcagaacttccccttcttccaaactatatacaaataatcagttaatcagattaaaggactcttagtaacattgaaatcaaacctttgtgtttccaggagctctgagaacaacaatttttttggagcattgcaatctcttgagtatccaaaatgattctgtaatgatgtctgtgaggtcagaattggagcagcaaatggaattcctttaagggcttcccatcaatggacagctgattccagaaatggaggaggcacagtttgtatccaaattcataagcacaagtgggagaaattaggctttggtaaagagggtgacattcccaaaggaatcatctgtgaagttggggaaggaattcaagctcagggctgctgttctctaccaggttcttcagccagctggacatgctccccaggtttctactcagtctggaatgttagtaaaagtccacttcctctccttgtttctcccttctagtgaaaacgttcctcttctctaccttcctgacctcaagaccattgttccacacatcccccctcaggatcccaccccgccattctcattctcattacattgtttctggatccatgtctttatcagatgcagcccactgtccctttcagaagatgccagaaaatttacatatgtgatcaaatgttcccatcacaacagttctttccagtaatcccagtgctgggcagctgattccagtaatggaggagacactttcagctattaggcaatggatcacactttcaaaggagattgagcaatctcctcatcaagttgtacttagagcacaaatctggtgccaaaaggcactaccggattcagactgacagcactgagagttttgagtgaaagggaagttagactggtgttatgtgtattcactgggaggaactcaccgggagaaataaagagggtttccagtttattcattgtgtaaagcggctataatagtatttataggggttttgtgaatgtcaaataaaattatatttggaacagtggctagtgccataagtaggacttaacctttagcaatatgtactacattaaaaggaaggtggacacatgagtgatctctagcattttgtgactggaaggaaagagactggatgaccactcttcagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaaaaaaaaaaaaaaaaatctatcaccccccttgattcacttacctcccactgtgtcccttctacttcacgtggggattatgggaactacaattcaagatgagatttgggtggggacacagccaaaccatatcacacatgaaacacagaaaaaggacatctttttacatggatcttctgatatgcttgtaccaaagcccacagtatatcctgtcttcttgaaagagtatcatagttattcatttgccttggatggaaataatgttgtaataccagttaatacttttttcaactaaagggaatttggcttcatctccagttgcaaattcacatcaggaaatatcaaatccaaagatcaaaactcagtatctcatcactttcaggaccatccttgccacttgtctcaggcatcatgtacctggaagctgaaaagcaatgtacagaacctttgaattggagagatatcaatttgaacccagatcctgctacttcctacattgtgaaagggatcaagtttctttagttctctaaagcaaaggtttttcatctataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattggtctccatgtatctctggtccctttttcccctgtcttctgagtgccctggctccatggatcatccattctttatcctacccaatgggattcttctcgtcaacatccatttgtgccccagcttggcccatattttccctccattgactccacagctctctgtagctattgctttatcccttccttcacagccaaactctggaaagttggatattagaaatgctgtctccacactattcacaatagcaaagacatggaatcaacttaaatgcccatcagcgacagactggataaagaaaatgtggtacatataccccacagaatactaagcagccataaaaaagaatgagatcatgtattttgcaggaacatggatggagctagaggccattatccttagcaaagtaatgcaggaatagaaaaactaatgctgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctgctaccaggcccctatcccttcatagactagctgaggacatcagggacttccatgttgccaaaaccgtgagtctaatcagtgtttacctaacttgatatctcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaatcttttatccctcgtcccccttccacgcttccccccaaatccccaaagtccgtcgtatcattcttatgcttttgcgtcctcgtggcttagctcccacatatcagtgagaaaatatgatatttggttttccattcctgagttacttcacttagaataataatttccaatttcatccaggtcactgtgaatgccattatttcattcatttttatggctgaatagtattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatattccatcatatatatatattccatcatatatatatattccatcatatatatatattccatcatatatatatattccatcatatatatattccatcatatatatatattccatcatatatatatattccatcatatatatatatttccatcatatatatattccatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctcaaaaaaaaaaaaaaaaaaaaaaaaaaaaaccaaccatcagtgcagaagaggatgtggagtggagagactgcatcaattatattttgctgatgagaatataagatggaacaaccattctagagaaagttttgggaatttcttcttttaaaactaatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgttgggggaaactggataaagggtacttagatctctacgttatttctttcaacttcatatgaatctacaattataagaaaatttaaagtttaatttatagaaaaggcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagcatttaaagatgttgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaaggtgttcccttttaaacctgctcctctctgtgttccttttccatgaatggcattaccttgttgctccaaccaaaggcacaggagctggcctgtatccttcctcttccttcagtatcccctcttatccacttattaaccaatttctgacataatactttggcttcctttatatcttctttcatttatgagacaagttccttcagtgttttctagtgacttttcattacttggaagagacagttcatactcctcacactaccatgtaaagagctcatagccacatgcacacacatgcacatccacttgtgcacacatacctaaacacacacccaaaacagagagattgtctcatgcctgtggctgggtaaacacttgtccttgatggaatgtgtagctttcccatctccatcccaatcacctagccaaaaactctcctccttcaggcctccatttagacatcacttttccctcaagtatgtgtgattcttgtgccttatcctccccatcatcctgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgagtaagtgtttcttgactctggggctgtactgagttgaagaaggatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccatccttcaggtctcagctgatttttcacttcttccatggagccccctctgacttcacaagattgcgttgtcctgctcatatgtcctgctcagagcatgctgcatgtctcacttcatagcacctgttatttttttagtatagattttggttttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacaacttaacgcccttcaagattttgtgtaacagggaaaggagagaacacctggaatggttcccgcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgcagtgcagttcagtgcaaaccaacggaaagcccacagtttttttgtttttttggttttttttctaggtgtaaacaaacctggttgattgtgaggcaaagaaaaataacaaaaacaagtgagaatacattagattaatttactctttcttttttcccgctcattcataatgtgattgaaatcagaagtaaagaaagtaaaatcagagtgagttccctctgctcagtcacccaccctgatcacaagacttttggaatactgggaggcactgcatttaagtaagtatcagctgtatggagagtatgaggttaagatgatgctggatttaatttaaagtctcctcactggtttgcgtgaaggaagatttttatcaagcagagtgaaagagacagaatcttgaagcttccgcagaggggaagaagacagggccgtgcactgcgagtcagtatgcctccagtccctctggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatccttttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgctagggccagtattgtaggtggcaaccaggtacattagtctctgcccttgtggaactcatattcccatgtttgtaaaggagtctgggcctcttatatgtggtaaatgaagtgactgtctatgtagttgcctttgcaggacacaagtccttgccttagtttccctccagccaggactgccccaccgagactattcatagctccaacttaaggtgctttaataaagggcagaaatcatgacaagaaaggacgcttttcttcaggcaatgaattcagcctgattttagaagctgttttggagaggtctctgtaagcatattacattttattccctgcagtacaatatttatacatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactactctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaaaacagtgttccttctacaaatattctattggctggggctcattcactttcacacagtaacaaagaatgcttggaaatgtggccacactgtatacccccaaaagaagaggaattagtttggttcaaatttatctagtctctgtcatgctttcatcatcatcatcatcatcgtcatcatcatcgtcatcagctactgtggatcagcatactttcctgcaattttccaaatcgaattttgtggttatatattaacagagtatataaaattcattttccctacataatatgtattttattcctatatgtgttttctgcagtggtctgatttatatcaatgactaacatatagattcgatttgcaccaactagataatttaatctcttactcctccttgttgacagttggtggggtgcgccttatttttgaagaagaaaatgcttatccagttattcagccaatctcagttgacagcctatcacatgtcaggcactggaaattccgtggtgagcaaaaacagacaagtggcctgctttcaggaagtttctattctgttaagggagatggacagagtgttttaaaagaaaggagtattgtcctaagataattaaaacacaggaacctgacttagacagagattaagacaggcattcctaaggaagtgatacttcactgagttatgaggagtgagtaggagtttagacatctccagacagtgcagcacgctgatttgaggaactgaaagaaggccagtgtggtcagagctcagagactgagggagaagcatgatgcaggatgagttttgagagataaaccatgaaggacttaggccttgctaagcattttggcctttttcccaaaagtacaggaaagcctagccattttattattttataccacccatccattacaggcttttcctgaaaggtctttggcaataggggagctatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattggatttgaaccatatttcttctgctagccaattccatcttatctacaactttttgataattattttgagaaatagatctagatcacagccttccaattcctaggccaggatactttccatttttctacacagaccccattgcagtcctcccttcttcacaatcttcaaaatatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccctcctcctcctcctcctcctcctcttcctcttcctccttcttgcaaatacaaacacagcagggctctatgcagctggttactctaggctctggtaacctaacatagcaggggaggacagaagtcaatagcgtgagaagtctgtttttgtcacggatttgctagaagctattaaagtgttcttcctaagtctgttacttcataggttgagggaagtaatgcatcccacacaagaggactgggatatgtttaaagtagtaggaaggcatttgccactattctagtccatcctgcccatgctgcctaatgtttgttcctacagatcaaaatctcataatcttctagacttctagatacagaagagttggagagatcaaagccttgcctctgacccagattattcgatctcatctggcatatcctacactctagccatcctgacctgccgtgtgttcccctaaagctcccatccttttctgactttgcttttcctcattctgtcccctgcattgaaatgcctttcccacatctctatgtctaaatcttacatggccaattccaacgtaatctaatctctgaagattccctttgctccccagttagaagtagtcactccctgctctgctcactttttgacatatattaatttatatagctatgcatttatatgtgtatgtattatattccttacaagagaagcttttgagagaagggcctataacttttctttctatttgtgtttcccaaagctccttctggtgggaaaaatgctttgaggttgaattaagctcacattgaactctatgatgaaaccatttgcttatgaacttggacaagtttctttacaactctgaaccttctgaattttccaccaggagaatgggaatgaataagtaagaaaacttataagacagctcctggtgtagggcctgactcatgtcaggttcccaggaaggccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacataatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatagtgtagtttctgatgtcaaggaacactttagagagaccttaattaatgtagccatatgttgacttcctggagcactcataacaacatgggaagcccacgctgggaagatgctgagtaggaataagagaacaatgctaagagaagggaaatttcaccgtctgtgaagcgtctgtttagattttatgtttaaactttatgaactctgtcacttgctggtgaattttcttgctcagtatcttaaaatacagctgcagtgtgggttccaccctcttcacttaaaagggtgattaactgtttgtgatgaataattatttaattgccagttcagctacatgtgtgtagttgttttgcttctttcctcttcagtgtgagccaaatcttctcaataataaaaataatccagaattagtcaactgccttttatcatgttctcattcagcctgctggagcaagaacattccaattctacatcacctttagcttaaaaagtaaataaatagaagctctcactcagccagttgatagttttactctcacagcctctcctgtaactaataaagtcttgacttcatcttgaaccttttactctatctttggataaaaatttaatcagaaagaattattgctcttttaatacctgtttaacctttacattcgcgatgggtacaaaaccacttaagatttaaagctctcttgttatggacttgtatgctgacctacttttcctcagagatattttttgcaagaattgttgaagcttgacatggggatcactgcaaatgtctcagctttgccattcactgctttccattcctatgtcctccttgccctgttaattattttaacagagacttgctattttaaggaagctctttatcgttactaaatctttttttattgttaaactcctttttctttccagcatagaagtatgtcatgttttctgtcttcagaatgtgcaagtgcttaccttctcataaagtgtgcctgttaccttaattttatagtctttatcacaaaaaggtacgtaagtggggttcagaatagtgtcttgcacttaaggtttaacttaggttttagtttcttcatgcaagcaacttgcatatgtagagaggcagcatgctatatagtgcaatgttcttcttggtttttaattataaaagtgatttcttttctagtaaaaaatcaagttatgcacaaatatatagagtgaaagtgttttcaactcctctctctagaggaagccactagcagttggcatatttccttccagaatttgttgtgtattataaacctatatacgtgcgtatgtatacacacacagtagtacacacattgttctgcaccttgcttctttgttttccctaagaatgtatgcttgatatatttctaaaaataataatgtatatgggtctaagtatttttagtgatatagaattctataggatacatgaaccgtaactcccttagtcatttctctactgattagtatttaacattgtttcttttttttttttttttgccattaaaagcaaatatctttgtgcaattatcttcatgaaatgttgaagctttctttttttttttttttttgagatggagtctcgctctgtcgctcaggctggggtgcagtggcgcgatctcagctcactgcaagctccacctcccaggttcacgccattctcctgcctcagcctcccgagtagctgggactacaggtgtctgccaccacgcccggctaattttttgtatttttagtagaggtggggtttcatcgtgttagccaggatggtctccatctcctgacctcgtgatccgcccaccttggcctcccaaagtgctgggattacaggcgtgagccaccacacccggccaaaactttctgcaggatatatttttaaaatgggttttccaagtcaaaagtgtatgtatgtttccattttgatacctactgaaatagctctccaaaagtgaaaccaaatttattcttttcaatggtatgtaagaatgcctgattccccatactctcattaaccttgagcatgttccatcttttaaatttttgccaagaagattgtctaaaaatggaatctcattgtttgtatttgcatttttatgatttttggtggatttagcatcattttctatgcttagtaactgcttgcctattcatatcctttatccaggttttttgttttgttttgtttctttttggtttggttattcatgttttccttattagtgtattggtagttatatgagttttaaccctttgtcagtggctaatttggaactcctccacagatccctgggggtttcttagagcagctgactggctggcagagctctccatggccttacctccccttcctcttctccgaactcacacacacactgatcgaacagaatagaccaattattacctgcatttcatgttgggctttgtgcttgagattaaacaaaggttcccggggctaaacgtctaaaaaacattgccatggaatgaagagccctagattttgtcataaagtcatctgtcctaggctctacaatgtagcattttcaaattggaagagccttcagagattattttattaccaacacccatgtaatataaattatacagttaatatatgttgatatacatgcaatactgaagaaatctctaatgcattctatattctgtaacagtaatatgtattttattatttataatagcttcaacatatattgaaaactagaggcacatacgtctataaacagtgctcagggcgtattattttggtgtttatttatttattaggtatttattattttatttagtccatagatgatgcatttatctgagaactcctctgactcaaggcccagcaagaatctgctgcccacagttatgagtagctgaactgggccaagcttttaattctataaatagcgaatctatgtagacactcagctagttagtaccagagtggtacccagatccgtgatgtcttgactcttagtacagtgcacttttccccactttgccattctttgctggtgaccttgggtagatcttcttaactgctcagagcttcagttcttctctcttttaatgagagtaataatgcatgcattgatatcctgactaggatggagttggataaagactgttcttaccttttgtgaatagcatagtatcttacagaattgtgaggaattatccaagtagctattgcccctcatcatggtgttaaaagtaggattgctagtttgaacggtaactgcaggaattcaatgtgttttgattttagcatattcccgtatcatgtagaccagtgttaatatttttagtattttatcttagttcttttttttctgaaagtcttgatttttcccagttttattttttagatttgaaagaaaaagaaaaaggatgtaactatgactcttatgttttcaatctctctgaaatataacaaagtaataactctaaatggtcaacgtagtagtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccaacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttagattgttaatttctttaattattgttttatatttttcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatggaaacatatggacatacagaatgaaataaaggtgggaggatgatgagggttgaaaaaatacctattggatacagtccagtactcactcttcggtttatgggtgcactaaaagcccaaatttcaccactacacaatatatgcatgtgagaaatctgcacttgtacccccaaatatataaacattttaaaagatttaaattacattttctgtgagtagaaacagtttcatttcattatttgaagtcatgccttttctgtttcttgcccaattgccctggctagggactttcagttagttgttgaatggaagtggtgaacatgaacatttttgcgctgttcccaatattaagagaaaacattgagtcttttgccattaagtgtaatgttagaagtaaggttattgaacatgctctttattaagctgagcaagtttccttcttttcattagttttctgggaggtttaatcatgaaagtgtgttgaattttgtcaattgcctttagacataagttggtatgataataagacttttgttctacagctggttcatatggtaggtaacactggttaatttttaaatgttgtatcagccttgcattcccaagataaaccccacttggttgtgttgtactactccttttgtgtgttattggatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcattcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaatttggctaacagtattgtacaagttctctctattcttactgattttctgtcttctttttcagtaaattattagagggatactgaaactttgagcataattgtaggtttgtctatttctcctttcacttgtatggtttttgttttaatgtattttgaagccatactgttaagtgcacatacattaggattgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacaatcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattggttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaagatagccaatatctcttcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatatattgtttcttgactttttaataatcgccattctgactgtcatgagatggcatctcattgtgattttgatttgcatttatctaatgatcagtgtcattgagctttttttcatgtttgttgactacataaatgtcttcttttgagaagtgtctgttcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctagggcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaagagtataaattaaattccgcttctatctgcactgcccaaagattctgtgttttaatactaccctacaactagtctcttgcaactggttaataactgtagttttttttttctgttaccaatagtatggcattcagaggccttaaggcagtaaggcatctgccttagtgttctgcaagtgttcacatcctgtctctcctcagaggcatctatctttccttagatttcaggttacagtagtttccccaactcccacttatcagtagttttgccttctgcagtctcagttacccatggtcaaccacagtccaaaaataggtgactacattacaatagtcatgtagagactattgtctctctacaaagagagagaaagagagagagagagagagggagaccacatacatgtaacttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatgggtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcatataatgatttcagtaaattattgatataaaaattttcaatgaagtataactcatagaaaagtgtacctatcttaagtggccataggatatcatttagactgtaacataagagaactatagatattcacatccccaagcattaactgagaacctgttatacagtgggcatttaggaaatgaaaagtgaaggaaaagttactgaccttaggggtcttgaaagcgagaaaatgattaagtgctgtatacacacacacacacacacacacacacacacacacgcacacacgctcaaagagtagggagagaaaaattatgattggggaaatcaataaaagcatattggagaagacatcatttgatattaacctttaagtatagcagtgtagatagtgcgtaagaattggattatagaacttagtcattatgttaggaaagaaacctatggccttgttttatagcaattactggggatatccaggtcttttgcactggaagaaataatcttagaaccatttattaaggacagacccttacagatcatggggtccaaaactgtcttggggtcgaaaactttctcatcttatagatgaggaaactgaggcttagggaagggaagggacttgcctggggtaaatttttgctagtaaatgtacttaatgagatctctcagttacactgaaacgtttgagtattggaacattgtgcttttgttgttttctttttctttaaatccttaaaaaagttgtggatacatagtagatgtatatatttatggggtacataagatgttttgatatagacatgcaatgcataataatcacatcacggagaatggggtatccatctcccttcaagcatttgtcctttgtgttgcagatcattagaatattgtcttcatcattcttttattccccaccaaagtttttgtaaggtagtaagaggatctttgtggaaagaattcttattcccttacgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctccagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattcctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatagcttctgtatttccactcactcagtatgaagtttgctattattttccccaattcctggagccagttattgcagcaaatttagcatttggagcttatagactcatgctagacagacacatatagaatttacgaatcgaattagaaaaatggtctttgaataatataaattgtactccatgtatatttttatatatgaatgaacctactggactccagtgagattagcaaataccttagctatttcattgcaataaaaaccatttttcagtcactcatgtccctctgggttcttcagtgatattatttgatgtatgctttattctgtgccatttattgtactgagtattttgcatgaatgatcttatgtaatcatcagtaatctgttaaatcagtatcattattattcttgtttcattgatattgaaatataaaagtaggttatcataaattaaaaggctacgggtagtgataaaattttattccaggtagtatctccagaatatgaattcttaatcactactcgtgtttattcattccacatgtcactgaatgcctactatgtctagcaaagttctagattctcttgtagttgcattactcagttattggctagataaccctaaacactgcagaaagctgcactctgcccccttgggattgcctggctccataagattattaccgttgctgagtttggggacccacttgagcaaatctagcatacttaaaaggaagtttttattctggagaagttttgttaacaaaacatctattggctgggcagagtggctcataactgtaatctcagcacttcgggatgccaaagtgggcaaatcacctgaggtcagaagtttgagaccagcctggccaacatggtgaaaccctgtctctactaaaaacacaaaaaaattaggtaggtatggtggtgcacgcctgtaatcccagctattcaggaggctgaggcaggacaatcacttgaaccggggagacagaggttgcagtgagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataagcctgggcttaagattgtatctctgagtgagacaaaataatagatgattctatctccctttagaaaaaaaagaaaaaaaaaaagcagcagcagcagtaattgactcttacgcttaggcaagaactccacaatggatttgttggggaaaaaaaaaatgttttcctgcttgtatgtgttggtttagattttctgttgtatgtgtgttgtgaaagaagactttggataattattgcgattttccaagcagctggtcttccaatggcattgttacagggtcagtctattttcctttaatctgaccataatgtcatagaacactggctgtttctttggcaactgttcagggaagactagctgttttctctacctcaagccaatggtggactgcaggcaggttctcctgcaagccacagggaagcagttttcattactggggtctttgtatcaacaaatcacttatttcactgtgattctgttgagacaggatccgaaagtaaatttcataagaaaaaaatgattatacatcaagctcaggtgactttaaaatttttcctttacattgagtaaagtttctggccacttttgaccttttttttcaaatgacattattgatatgaaatcagaaactataactgataaactacaaactgctgtatagacacttttctacacaatggtcattgcttttattctttatctaagcctgaattgtaaggcttccttctctttttttttttttttttttttgagatggagtctcgctctgtcgcccaggctggagtgcggtggcacgatcttggctcactccaagctccacctcccgggttcacaccattctcatgcctcagcctcccgagtagctgggactacaggcgcccaccaccatgcccggctaattttttatatttttagtagagacggagtttcaccatgttagccaggatggtcttgatctcctgacctggtgatccacctgccttggcctcccaaagtgctgggattacaggcgtgagccaccatgcccggcctgaatgattccttctcatcttctgggaggtttttctgacttgctttctcaattccactctcttaggcagagcttatacctcccttcatgtatgttacatgtacatgtattgagtcagtgcatcctcctaatgaaacttttcctgagatctctcttatttactttcttccttttctgaaattctctgctatttagattcagtgccaaagaaattgacatttttatttacttgctgaggaataaacagaactcgaaaggatttgggaacccaagaccaagttttatgaaataactaatcttgtcttcctaaatactataaaaatcttatataatccctaatacttagcatagtgctaagcaccgaataggaatacaagaaatattgcaatgatctgaattgcttacaaaatattgacaacaacttcttcattggtaaagaaaagctgcttttgacctttttttcttcctcaagagtaagtagtgagaagcataaagtacccaagagtttctttgcctttttgattgttgcatggaaacaagtatttgcaaataattaagatgggaaaatttggctccttgaaaaggcaggactgctttcagatatatttgaaatgaacttatacagaagccaacatggttatcagagcaattgggtctatttcctatcatctcttcatgatatcttgtaaaaatgccctgtgttgagagcactggtgatcatagcagtggggttggagtagaatctggtgcgtttcttcctctacagatctcctaatagcacttgccctgttttcacagagccttatcaaagtttgatgtagactccagtgtgtagtagtgggcagtgacctaccagatgacctctttgaacaagagctagtttgagccagtgtatagctctgaatcgatggaagatccattttcaaatttcaaaagggctgttaaaacacttagttctgtattatagagatacacaaatggatataacaaactggatgtctcttctgcagctgtttcaattcgtatgccatgttttctatccttcttgctcctggcaattttctttcctgaagcatatcacaccttcttacatttgacaagcattttcacagctactgccactccctgctgccaaacaaaacccagccctgtttgaattcttgagggctgagggatggagaggagacctgtttgactttgaaatggttttaacgtcactttgtatacagaacaaaaatggaaaaccagatcctgtgtttgtctaaaaactaaaatttcaaaacctaacctgaggtggagaaacagatactacagggcaaggaaatgtctgggctcaccgcaaaggaatgcagcaagggaaccacctgcagacacctgtttaagagtttacgtttttgttcttccacacgattattatcttagtatctcaactggctatacatgcttttaggaaagttgcagggatcatattctaaggcgtatcaaatatgttcagagtgcaagcatgagcagaatctctcctctctgctagtgaggtcctgtaggtctacaagttactaacttcaggcttacagaatgttagaagtaacgggtgcatatcctgtaatcaatcccggtattgagcaaacaggcacaaatgacacccagcaagaaaaatgacttgctcaagacaccacagcaagttcatggttttctgaactgaattccaagtttcataacttctaattaatcctcctttttttcccccagtacagctaatatgctttttgtgaataataacatataataggtgtaatctgtcagaactatttaatagttgatagtatgtatcctcagtttattgaggttcaagctcttctgagtattataatactttctattggtattttctctcttgagctattccctaccttgaatctttcagactagagatttcagaagattacgtagtgtctgtgacttcaactacacatggatagtccacaggactctggactttcacggttccatgtcagttggacaggtgttactctaaggccctgcaaaaatataaagtagtttgagaatcactctcctgttaatcttcagtaaaattctgagctatttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctatatgtcaagccactaactgccagccatcagtttgaaaaccgaagcaattaagatcgctgtccatcttacctgaaagggaagctttgcactctaacttgaagtagcctagaaatttcagaaggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgtgtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattaacttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatttcctcttagaattcattctaaacttctttaacagaaattatctttttttgattcatattctcccttttgtcctggttaccagacagcacaagtgaccatcatgtttagatttctgatacagttctctcttccattcctctctgtagcctctgatttttttttcagacttcagttggaaaaatcctaatgaatgtaacttttagttacaggttgaattcttttgaatgtgtatatttaaaataagtaatgcacatagttaaaaagaaacatgtttttaaaacagtggttctcaattatagctaaatatttagaattatctggatggttttaaaactctgatacccaggcagcatcctagatcactcaaatcagaatatctgggtttggtcacggacatcagtattttttttttaaagctgcccaatgtcattccaatgttaagattcattgttttagatattctttattatgatgttcatcatttttacagaaacacatttccaaaaggataaatttcaaaatcacctgtaaacccataatttattataagtcactcttaacacctaaaaatagctaacctgctaacctttttcttttgctttttccttcttcttttaaactaaaattacaataatatatgtgcatatatagtgaatgtattcatttatatattagacacaatttacatatttatgcttatatatatatggcatacatgtacacgttacaatatgtgtatttgttttattccaaatctgttttattctcagagacattttcccatatcttcccagatatattttctgagaacctggtttttaatgcttgtataacattaatacttgtagttagaccattttttttactcattcttctattcttacatattaatgttgcagacaacatccttaaacaacttttgtgtgactaatccaatttttttccttgggaataaattatgatctattgatttatttctatgtgggctgaattttgtccataagaatgaaaatggtagccccctaagatgctgtttgctccctgatatctcatttttctctagaatacgaaggaatggctgttttctgctcttcctaaagattcaggatgtaataatatactgtcacaggtttcagaagcatgggaccttggcaccgaaagggtctctactagctaagttgtcttggaaatgagtgggtccacttcctcttctgatacaggaagaacagggaggtcattaaatgatgacggggctctttgaagtgaaatgaagcaacattggagggtgtagcatgtaaaaactctcttctcggatacaaaaaaaattgagctacttgggctaggagaagtgagcctggatttggaggcttaaggtttcaggaaggtctgagacaaacttaagaagaaatgcatcaagagggttggaagggacagacgattgatgagagcactgaaattccagtgtgatttgggtcacccgtgtgacatggcatatatttatgggatacctggaaaataagggagaaacaagacatctatctctgtcacactttggggaagtatacgattaagttccacactctgtggtggaaagaatgtcctggaggcccccagtctttctcactgtgatgccatgctcatttgataacctcataaacacatttctgttcttattgccttacccattctgatgcactgatcattttttaggccatgtgaacagggcagagcttgtcattatgcctgggacatagtgggcattcagtaggtgtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttataattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgagagagtaatggaatgtgtatgtctctgctcttgaagataccaggggcacctcgaaaactcccctccccagcccagggtcaccacagccttaaccgactgcctcctttgcaaacctttaccatgggtacctagaaaaagacatacacacacacatttcagcttatggtttttgttcgtttgtttttgttttttgtttgtttgtttgttttgccagatacttaagatttaagggcaatcttaagggaaatctcttctcccatcttgactgaggcacagagatgtcctgttcccatgctgttgatgctgacagacgtaggacacgtttttttctccgtgtgccaccacactcaagcagaatgtataagatattttctgtctaccaaggatacctggtgacataatcatacctagcctttctttcctccctccgccccctcagcctctcaccctgccctcccatgggtctttatgtgtgctactctatgtagagtacaactcataccggatagcctgttacttattttggttcaggagcagctgcagaggatgaactggagaggacagtctacttgcaaacacttgtagactctccagtggacaggttacctctaaagaaagagaagcctacgctttcctactcactgaagttttttaccatttgcaagtggatccaatatatgtttgttttgggtgaggggctaacaaaatgctctgcggtttctgcaggtttccttataggagatcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgatgataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggagtttccattctagtggggacacaataaacaaaataattggcaaattatatagaatattggaaggaagtacatgctgggagagaaataagctgggagggaaaagggagtgctgggggagaaggagctaagagtctcagttccagagttaggcagcctgagctggaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctcaaaaaaaaaaaaaaaaaaaaaaaaaactcagctgcatccttcccagtcatgtgacctgggcaggttaagagaactccctgagcctcagttttcttgtctgtttatcaagagtcattagggaaactagtatctccttgggttgttgcagggattcaatgagatgacacatgtaacacaatcattacctcgggcctgtctcctataaatatagtgattgtcacgtttgttatttaaacaatattatatattgtgttttaggtattatgtatgtaatatatagtgtgaatatatgtatgcgttatgtatatagcattatctgacttcgtgcctctagtattacatgcttctcaaaatatctatagttttgtcggtatttctttctcctactagattgtgatcttttatcggcaaagaccacctctcatttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagttgcatgttactaataaggaatcagaagctcagagagggggaatgaaagaatccaagtatatgtggctaaaattggccacgtcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgagtttattggacactgcagaaattcatttacattgtgtgcttaccctggattgttgttgagtccagctgactgttgcttcacaaattaactgtcctttgagacttggaaatattgaaattgcatagagtttttgtgaaatctcaatcctgtagtattgtgtatattacaacaggtgctcaatagacttctggattattaaattgagtaatatttgtagcaaagatctgtaggctgaattataaagctaatctgtggggggatgccaagatttctctatcattctgctatgtttgccatggtctaccaggagatggcgcctggtaagagttccatattttaatgtattctggtccaaatcactggagttggcaaagatggagaaggaggaactgagcagttcatccccaaagacatgatgacaccactataagtgtgaagccagcaagagtgcaaagactgagagcagcgtggtcatacctagacatttatctggagagcaaaatcaagcactggggctcaaagggttcagtcccagcagttaggagagagaggagtctcctaggagtagttgccccaacagctgctagaaagtcctgatcctttttggtctgagccaaccaggtctcagcccagtcccacttgcctcaatttaaagtgacatttttggtctctagctgggtgcttccccctctgtagcatataacaaggatacactttcaaggcagggagcctggaggacaaggagataaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgctataccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgttggggtgtaacttaccatgattacatgttgtgatatacgagtccatctcagcagatagagagactctccttgacagcttgaggaaataagtgaccatatgagagaagctcatgaggcaaggagctgtgagcaacctttaggagctaaggacagcttccagcagacagccaacaaaaagctaggatcctgactcacatacccacaaggaaatgaattccgccaataatctgaatgtgcctggaaaagattcttccacagccaaccctccagatgagaatgctactcagctgacactttgattgcagcctgtaagactccgagtggaggacccagccagagtcatgcctgggccctcagaaactgtgagatagtaaatgtttgttgttttatgccactgagattgttagccaacaatcaaaacctaatacaataataccctttactgttttctagacagctgctatttagaaaagcctcccacccaataaaagagtcccctttatagttttccaagtaggtggttatcagggttctgcttcaccatcttcagtggcaaggaacttccatttcacagggcaaccatgtgtgtattacagaggcttgcatgttgtcaagttcagctgtggtcttcagcgggagcctaggacatgccagggatttcaaggtaggctggtgaggggttcctggttttcttggtcctgaaccatcccagtgccattctaacagttgcaagtctgcctccttcatgacaaaaggactggaggaaaatgtatctggcaagtcgataacactggatcgtttgctcccagctttaccacttggcatcagtgcaaactttcacccagttaaataacttaatgagccctgctctgcatgcttgcttcacagagttgtgacgatcaagtaagacagcatctatgacagtgtttgttggctgtaagtcagcaaatgattgcaaatgatgattattattaaaataatagtcatttgtcagtaaatatttgtcaaagctggtccacactgagggagacaggctctccagggaaactgctgatgcagagataaagaggagaccagccccagtttggaattgcatcactgattctgaattccccatggtacatttcaggtcttgcttcaggaatttgttttttgttttgtttggtaggaacaagaatcccctagagccagttatgttgtcatcaaacttagttgctaattaggcaccaaagcaaacctatgccagtgagacagagttgaaacttgaattcctttctgcaggtggagcgttggatcctagaggcggtgtatacagcttggctattttgatgcttctgcatgcaagaaggtttaagagaatctgagtaaagcaattagcatccctctgtctgcaggcaaaactggtttggacatgcttctctcttcttgaagggctgttagagccttggcagtgtatctgacgaaagatttcactaagcaaaatgtcttcacttacaaatccagccactttgcactctcagtcagcctcaaattcatttattttctttagagtttccctacaaccacgaaccaccaagaattaaattaatccccaagagcctgagcaattatgaggatgttgaatctatccattcaaggatgtcccagcaaggactgttcattcttttaacgtaaactatttatatgttttgattctcctcatttggaagaaagaaataagttttcatatatgtatttttcagggtgtattttatatatctgtttatattacactgttcacattactattaaagcatccccattttattgtaagtttattttgcctgcttcgggaagaacaagaccaagatcccattattaaaaccaaaatcttccacaaaagtttccttttaaaaacttagattaggaaattttcagtcagccagccaactctatagcctttgatacttggtcctacaaagttttcttcccctttggtctgaatgttttcctttgtctgtgcacactctattctcctgccagcatgataatacatgctgctttgatatcaagtggcgggaacatatagaaatgtgctattggtgctgcaatttgtatctttgttttcatcaaacttattatttaccattttaggatttttttgtttctttttgggtgtttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaaatcagctgggcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtaggatcatgtttggcttttcaaaactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttggcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttttgtgttctttgcagtagagtccaaataaatataaattaaaatgtttccaattacagaggaaatattttcagtatcttcccacaaataacactgggtttataaggcttggttcccgggtttcatggtcatgcttggttgactaactttgtgttcatgtggcataagattctaaactgtcagaactacgtgggcttttagagcccatctaaatccttctcactcacagacgagcaagctgacatatttgcctcatttattggcagtgaatgaattaaaatattgtgccttcatcaagatattgtgtgtatattcacaatgttgtttttcataaatatgtagcattactctgttttgtgactgctcctagactggctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaacatatgcaaacttgtcttattaaaaagcctatctctagtggttcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcatatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggcacatacacgccatggaatactatgcagccataaaaagggatgagttcatgtccttttcagggacatggatgaagctagaagccatcatcctcagcaaactaacacaggaacagaaaaccaaacaccacatgttctcactcagaagtgagagttgaacaatgaaaacacatggacacagggaggggaacatcacatactgggtggggcctgtcgtgggggtcgggtgcaaggagaaggagaggattaggacaaatatctaatgcatgtggatcttaaaacctagatgacaggttgatgggtggagcaaaccaccatggcacatgtatacctatgtaacaaacctgtacattctgcacatgtatctcaaaagtaaaattttttaaaataagaagaagttgaagtcagggtataggaatcacaatttgcagtgctatctttcacacttcttaccacctgatgaaaatcaccaaatagtatttcttcttttacctaacatctctaggaaagagagaaccctgactgcacctacaagtagggaaaggcatttgagttacgcaaagctgcttttaactctgaaactgtcctacagtgtagcatataaacagggaaaacattttattggtgttttaatagaatcttatctaaatatctggaatcttactgcaagggccgatcattactctaggtagatttcaaggcccacagctccattatgatgtcaacaaggataactgatgtttattctgtagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggcgcctgtaatctcagctactcaggaggctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaacggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatattgacactcccaaggataagggaaggcattacatcatcctttgtaatggtgaatcttgtgcatttgtagagggctggactttggcttctaccatattgtttagctctgtcaaccccacacaaggactttatttatttatttagacagagtcttgctctctttcccgggctggagtgcagtggtgcaatcatggatcactgcagccttaacatcctgggctcaagtgatccttccacctcagcctctcaagtaactagcaacacaggtatgtgccacctcatctgactaatttctttttaattttatatagatgggatctcattatgttgcccagcctggttttgaactcctggccacaagcattattattatcctcatcttacacatgaggaaactaccagtgaagtggcttgcccatcatgtgaaattacatatgccagtactagcctgttctgaaatccagcaacattcttttccacctctagccttgtttctagcaccctttggcctccagagcaagctggggttcattttacattaaaagtagagccatctgatgtggcgggcatccaaaacacttgggaaaatgctactctgtttagaactcgcttttcttcctcccgggtcccagtgcaggaggtactgtgtgctatgtgggccatcagactgtccctggccatggcaggagaattaggagaccaccagggctgtagttaactgtaggtccttcattaagaccagccaattgatagcgtgtgttcatgagtccttgtgaagtcttttcatcagccacgtggaagaccccttagaaaaacaatctctgtaatttgtatttttggacatagtgctttaggaaggtggatgtctgaaggtgggctgggtttgaaacatctctcaatgccatgggacagtgtggtacagtgtcctgacaacttaagctcatcctgacaacttaagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgatccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagcttaaggagattttgggctgagacgatggggttttctaaatagacaatcgggtcatctgcaaacagagacaattagacttcctctctttctatttgaataccctttatttgtttctcttgcccgattgcactggccagaacttccaatactgtgttgaataggagtggtgagagagggctaatttacattcccaccaccagtgtacaagggttcccttttctccacatcctcatttgttttttccagaagacagcatttgctattacctgtcttttggataaaagccattttaactgaggcaaaatgatatctgattgtagttttaatttgcatatctctgatgagcaatgatgttaagcagcttttcatatgcctatttgccatttgtatgtcttttgagaaatatctatccatatttttcgcccaattttacatcagattcttagattattttcctatagagttgtttgaactccttatatattctggttattaatctcttgtcaaatggatagtttgtaaatatgtttccctttcactggtttttgtcttcattttgtttgtttcctttgctgtgcagattaacttgatgtgatcccaattatgcatgtttgctttggttgcctgtgtttgtggggtgttactcaagaaatctttgcccaatccaaagaacattcatctttgtcaaatgagctatagaattaatgtttttcctatttttatttattcattttatatttatttctattttatatattcatataacaatatatttattcataatatcactttgaatatcatttgttttcatcttgcatttttctcatttttcattgaggcctaatttacatgcaatgagatactcagatcatgagtcgtagttttaggagatttggcaattgtatatattacccaagaaagttcccttaagttcccttattcctctttctattcaagtcccatctgccaccctcagaggcaatgactttctgacctctatcaccagaaattatttctatatgttcttttaaatcagataagaatcacaccatatttattttttgtatctggattctttcattttgtgcagttgtctgagattcatccatgttgttgtattagcagtcttcatctttttgttgtttagtatgccacgattataccataattaatttacccatttttcttttttatcataatcttatataagggaaaaacatgggaatacatgaactgtatctttggctcaaatccatcttctatcagttctaagggcctcagggtatttgccatgaggggctgtgacaccagcctggactattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaagtatccaaagcattggattacttgagataatatttctggtcctcttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggatatgaacagtaaaggagaatatttttctagcttgtgttaaatcaataatgtagtgattccaagggaattgagaggttcgtgtatttattcatatattagtcaaaaattcaaaattctatctctaattaaaaaggaatttgagaagtatctaccatttttattgtccatctctttggacatatgctttgcagcacagtggagcggaaggagcgtagacctacagaaatttagagggctaaatttttaatattggcctggctacattgcctggactttgggaaaatcacttaagctctcttagccttagtctttttatctgtaaactgagaataataatgccagtttttcaaggttgcattgaggatcttaggtaatacatataacattcatggaacataaaatgtgaaccaatgaaggtgccaatgcaattacaccttcattaggagttgtcatttctgcggcttctcattagaacatcaaaattagttccttcaatctttactgaggcgcagagctttaaactctaactttgaaacttccaaaatgaagtgtgaaaggtctgaggccttgtgagtttgaaaatgcagttcacacttcattttagaagctccagaattttttaccaaattgagattggattcaggaaatcatattttaaagccctggttcatgccattttctaaagaagtacctagaaggccataatcagaatgcttattaagtgaccacactttgaactgcattgcagataaattacctctgtgtggggagatgtgtcttgagattctgcggtcaaggctcagacagccccagagctggaaacctcagagcatttatgcctctgtcactaaaggatggggttatgggggctggacagaaagcttgagagagatgaaaagttcagtgggcttgagggaggattactgaattacaataatatccacaccgtaaagtgaatttgtacttgcaagagacacattatttatctagaattttagaaagggtctcttttcaggtcactgtgtagattgcctgtgatttgttctccttgattgaatgtgagtgagtgtgaagcatatctaaacaggtctcacagcaagtttctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccgtctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgacagagcaagattccatctcaaaaaaaaaaaaaaaaaaaagagagagaaaagaaaagttacatgtagagaactgtaagtaatcttatctggctagaatatagggtaccataggggaatgactgagcatgggtcagagttgtaaacatccttatcatgccaatgagttggatttctccagaaggcatagagagatctgtttatagtttctaggtaagaaagagtttatgaacttgcctgtgtcttcgaaatatgctgtggcagaatagaaaaggtgatcaaccagagtaggacagaggccacacacatctgccctgaggtcagatacctatacatttattgtgtttgatagccaaatgattttaatgtaaactagttgcaaacatttaaaatttgggaaattttacataaaaatctagattttcgagcttctattaagaagtagagtgcacaatatctgcctagcaagaaacagctgttgctgagaagtgtcttccaccttcagctagagcatgcagtctgacatttgcttttctggttcttgtatttgagtgtgagactcttggagtaaagcaaacccagggtcagaaagatcactggtgatgatgttgcagttgtactgtcaggactgatgaaaacctaaactaaggtggaagccttgaggaatgaagaggagggcaaggatggatttgctgattgtttagatgtgtcatggatgaaagagatggagaaatcaaagaagactctcaggttgtaattttaggtaactgggtaggattcccatgtagtcagaaacccagaaagaagagaaggctttgggaagatgacagtgtattcaatgtggctttttgtggttcaagactttggaaaatattgattagactgttgaaaagtacttataggtcaggaacctggtcagaaagtattgtgctaaaataatattgttatgacccaagcagttgtaaaaataacttttattgtctaactctcacagtttatcttgaactcttaacaggttgtcaggcaaatatctgttcttgaaaccagaaaaacaaatcaagaaattgggatatttgaaatgcctagagtgggcttataactgtaaatgatattttacaatggaaaagtagaaacagtctttagcagccaatgtgaaataactgggtaatgttatttaatagaatgcaaatttgaaatgagtgataaccattatggagaattttgttaggaaaaaaattaataaagtgaatgtaacacatgaagcagagctggaactaggaagaaggaagtcaggctcctggggaaccaaattaaggagacttcccctctcaggcacttgtgggaccctgacggtaagcatctccttaggtactgctcccatcctcatccttgccttgagtttttgaaaaatatatgttagaaatgtttatgattatatatcacaaactgttattctcaattttatgaaattccctagatatgattacaatagtcatttgagatttatgatcttatctaattgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgcgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattcttacctttaaaagttagctatacaagtacatcatataaatgtcatttactttgatagctgtttatattttttaaaaaaagaaagaaaacaagactggtagagaagatagtctgaccgcaagatcaacaataataataataatgtaggaccacagaaaagtaaatgaaatcttggactgcattcatctaaagaggagcatgcagaacagggaagcagcagtgcctggagtgctgagttcagttctgggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctctttagggctgttaaattgaaaaggcaacagatttgtctggagaggacagaagtagggccaatggggaagaagatatttatgtcaaaataagaaagctctaacaattagacctaccagtggaatgaacgaaccaagagagtgagctgtccctggacatggtataagcagcctcaggggctggaaaaacactgactgactgggaatgttgtagagggaatttatagatcagattgattggggaaaatagccccaaaggttctcctctctctgacatcactctatgattctatgtgaagttctagctttttaactatttttttgtataattaaataatttgtctttattgattgagaactaatcattaaaaaagctactgtcttttcatgtctagagatgataagaataatactacatgcttttgaagaaaaggaattttatgcaaataatcccataccagtgtattacgcttttgcagggataatcaagagcttgcaaaatttgaaaccacattttcccctgtatggaggaggaaagtctattttgcatccgtactttatgccttgggcattattattgctcatatgctctaggatttttaataaacctaacctgcttcatgaaattacactgcattaattcaacatggccatgtccaaaatttaatattcattcatttattcaagtatttattcaacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaagaaatttgattgtgtctcaagtgggcaagtttggcttggggtctttcatgaggtttctggtgtgaggtctctcaaaggctgcttctccttacacctgggccaggagtgtttgaacagctagtctggaacaacttggggtcttcaggtatctccctctatctgcatgtggtctctccagctttgggataacctaacttcttacatggtaactgctatagtttgaatgtgtcctttaagttaatgtgttggaaacttaattcccaatgcaacagtgttgagaagtggggtataataagagatgattaggttatgagggctctccccttatgaatggattgatgccattattttggaagtaggttagttattgagagagtaggatgttataaagtgagtttgactccctcttgctctcttgctgtcatcctctcttgaccttctgccttctgccctggaatgacacagtatgaaggccctcaccagatgctggcaccatgatcttggacttcccaccctccattatcataaaccaagtaaatttatgttgttcaaaagtgacacagtcagtggtattgtattatagcaacacaaagcaaactaagatagcaactgaggacttcaaaggtatgtatttcaagagaaaactatatcacattttaagattagcattaggagggctgggtgtggtggctcactcctgtaaccccagcactttgggaggccaaggcaggtggatcacctgaggtcagcagttcgataccagcctggccaaacatggtgaaaccccatctctactaaaaatacagaaaaaaaaaattggtgagcacagtgtcgggcacctgtaatcccggctactcaggaggctgaggcaggagaatcgcttgaacccgggaagtggaggttgcagtgagccgagattgtgccagtgcactacagactgggcaaaaagagggagactctgtctcaaaaaaaaaaaaggttagcattagaagtcaggcagcatcactgctatgacattctcttggccaggcagttgcataggttctcccaagacctcacctcttagtggtggactgttagtatcacattgtgagatgggatgtgttttggtgtagtcatctttgaaaattacaacttgccatagcatatgaacagataacactatacttgggttctctgctatggtgctgtgaaagaacagaagaggagagtgattaacagaagaggtaacattcacatatcatgggccatataatttgatgtatgtaacttgttaaggaaatacgttcaaggcaggggcaacagcaggtggaaaggcatgaaagaacaatgagcacaaagtgtttaaaagcttgggttgacaggaacaaagactgagttgtaggagaggtgacaggctaggggcctagacaggggaggtaggacagcatcctgaagggccttgaacatcaagttaaaacgtttggctttggggagcagtcactgtctttagagcacaggcatataaactgatcgtctttggtaatctcttccatctacaatctttctttcctttgatagtaaacatatcatctctgttaaagttgcttcctagcttaaactgaacacagactccaaaccattgaagcactttagatttttttcttttttttttttccttttcttttactcaccacaaacaactctagaatggcatgcatttgaacaaaccaaaagtgatttcactcttctaattttcagtgctttttggctaaatgcagagtgagaaattcatacctttttcaagcagtgtgggttctttttcccaatttctgtcatccatctggttctctggaggtcttggaatccaggaaagtgttagttcactgtgctgaaatccaaaaaagactgctaaactgtgaaagaaaatttgcattccagagacactgaaagagttagtccaccacccttttgcaacagcaaggagaaaacatctgtatttcctgcctctttgtctttaagcagttatagaatggaaaaccctatactccctggctgtgcgtttcatacctagttaatctaaatcacttttggcagggtgggggaggaatcaaaacatggaattattttatttctagtgtcagaaaatattacagccaagatactgtttaagggaagcaaattacttcaccagcttccttttgagctcctcatgaggtttaattctcatgaatgggtcctagagccgacatttgacatacacatcagcagtgccctcttcggaagggaaccgcacagtcacagccatgatgttggcatgtctttatggccttcctaagtcatgtgctgtcttttgtcttccattggcagaaatacaattagaaggccttgttctcaacagaagccaaatgattgccaaatctgttcaactgatctctagagaattgaagttagctcatggccctctggctgttctctttgccactcccaggagttataggcttaaagttatccctttcttttgaaagaggatcaagtttggttcaaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtatacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttataatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgtgcaacaatcttgttttgacagcgacaaaacccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgtatggatttggggtataataaggtttacacagaagaagagctttttcacaaaattcccaggaaagcagggggaaactcacttagaaatctagaagcccattttatattatgacattatccaattatcccagagtatcatatacacaattccttagataatccatttgttgaaaggacagatataaaatataggagaattaatggtgaagggaaaaaatagaaatacggtgcttcagtgtggtagttacattaaatgatcaaaggatgacaagttaattgaataaatgtcttagccccttgaaatttgtatagggaatttataaaactaacatttattatatagtcaggactgggttctcgctttgataatatgtgaactcatttaaacctcacaacactgcaatgtagacatttcagtctacaaaaaccaaaggccagaaaggtcaagaaaattgcctagcttttcgaacccagatcacctttttcctactgtttcactaattctcttactataatatggcagaccttctttgatgtctgagttaataaatcttcacatgacttatgttgtaaaggcaaaatctatcatttgacttgtctcggaaggaaaggaactcaattcttttctttctctctcaccatagtcttagtcttctctgatatgttcattatgcccatggcatgagggtctgacccacagtcctcagctcttaggccccttccccctgccccacatttttcaaggatcagaacacattcaaaagaagtgttttggaagacctagcatgtcacatgggttatgcattttaaagtaaaatattacctctccgggcattaaggtataaataaactaaatgttctataattgagattttcttttccgatttagtaaagctcagatcacaatcctaaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagttttttttcaagtgccaaatccaatcccaactagaatagattcttaagagtcatagaccaccaccatactgcctgctctctcaccattcataagtaattactctcttctctgcattcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcatctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatcatttgggaagcaatcttgatgaccagaatcaaggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattacttatgtaaatgaagactgtatatcttgattttaaatactcaaaattgaacacttacatatacctatgtaatatgtaaataatggtaatattcttattctttatcatctcattagtagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactctacgtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttcttgataactaactgtgtgcaaatctgcttcagaatttgtttcctaggaaacacaacctcagactatggcttcatgggaggagagaggagtgattgcagtttagtcatagaggttgacataaaccactaaatcaagtacattgtgttcagtgtcataggggaagcataatacaatcctatgggagtggaagaagttacttacttttcttggaatacaacagaaaaagatttaggaaagatttttcagaagaggtgacatttgagtttcactttgaagaatgagtaggcattctctaagcaaagtagaatacaagatagtctgggctggtaaaagaatgttgcttattaaagatgtggcagaaagctcagtgtggcagctgggaggaggagtccatgggaccacgatggagctggatcagcagtccagtcacaaagcacgctactgatattgaaggttcataagctggaaggtgctcttttcttttaaatccccagctatcaatgctggcaaccctactagacaaaaaaataaataaataaataaataaaagaaaaaagaaaagaaagaaagaaaaagaaagagagagagagagaaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcgtgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggataattcatattcttcacctagcaactttcctttttcatggccacataatgaattccttagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccattacagggctgactaaaaaaaaaaaaaaaaaagtaaaaacccacagaggagcaaaacacaagtcctgggaagacaatttccagccacattagctcacattgtcagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattcgttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggcacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacagacacttcttgcttcatagccatttatatatcctcatggtaaaagagcagctacccctgaatttccacatcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttctacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaactatgcccatgggtcaaatccagcccattgtctgttttttttttgtaaataaagtattactggaacacaagcatgcccatatgcttgcatgctatgactgctttccagctataatagcaaagttgacttgttacaacaaagccagaaatatttactatatgggactttagagaaaagtttgccatcacccatgctgtaggaaacaagggaaggaacaaggatagcagtcagaaaacacatgtcctcagttctggacttgccacctactacctgagtaatactagaaaagccacttgacccatctaattgtgtttccttctctctataacacacttctttggccagtttgttagttaattggccgataacacttgttttctatttgtaaggactgtattaaagctgtagatgtggtttgtaaatggtgataaatgccttccttagagtggtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcgtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcatttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaacctctgcctcctgactcaagcaattctcctacttcagcctcccaaggagctgagactacaggcatgcaccaccatgcccagctaatgtttgtatttttagtagagatggggtttcgccatgttggccaggctggtctcaaactcctgtcctcaagtgacccacctgcctcagcctcccaaagagctggtattacaggcatgaaccactgtgcccagccaacgtttggtttatatttttaagaactgtactaaacctatagatatgatctgtaaatggtggactcaggtttctgtatgtgtttgctgggcagtggctttgaagacagcctttgaggctatcaaagagatgaagcttgtattgctcaccaggttgggtatccattctatggcttccaagtgtgaagtcttctgggttaattctcaccactgtgttgattgtcaacagccaggaagcacttaccccaaggagtttggagatctgagactcatattttaagaatgaatgtcctaaccactttccaagtagcaaagaaagtgaaaacctcaccaaaagacgtgaggttgaatgaattaaaaaatcccagaggcggaaatttgcaacctgaattagacaaggaaggactcacttttaaagggcagtcacagcataaattgtgcttcacattattgatatttttagcttgtaattacacattgaaaaatccctgcgtcttaagggaagtgaaaagatctcaatggggagtatgttctgttactgtttctctcctttcttagacttatcctaatccaagaaagactgatacttataatcggagcacacatgtttctgtggctagaaaagactgatacattacacccctcaattaaaacaggaaatcaattttgacaaatgccaatttatatctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttataagccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagcttgccaggaggagggcagagaaagtgtgcagacagggagaaagggctgaactccatgagacaggcacaggtaagggcttgcactgtcaaagtcagatcacctggctctgtggtcagaataggctttgtggacggagaatgtcaagagtgttttaagtgggaaacaaggagattcctggcagagggaacaactcaggcaaaaagcagaggcacagagttagtaaagggttctctgtgttcagggagatttgctttgctgtaactagagcagcctgggagtagagattaccttgagatacaggagacccataagaagggatttacctcacctgcttagcctgccttttatttatttatttgtttattttatttatttattttgagatggagtctcactcttgtcacccaggctggaatgcagtggcacaatctcagctcactgcaacctctgcctcccatgttcaagcaattctcctgcctcagcctcccaagtagcttggattacgggcacccaccaccatgcctggctaatttttatatttttagtacagacaaggtttcaccatgttggccaggctggtcttgaactcttgacctcaggtgatccacccgcctaggcctcccaaagtgctgggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatctttcacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgtatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatcgaaagttgttttcatcaaatttacttttacgattattgtccactcagtgagctaagccttgaaatagaccacctgggattgtgagccctcctcgaattgctatcggaggaacactgtggggactatgagaaccacctcctgcctcttcgctttggtttttctcattatggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccacttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccacctcttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctgtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactactaattgctcagtttcctgaacgcctctagagctgcagtatatctgcatgttcttttcagtaaagccaaacttcccgcagagtataaccattgctgctattgtgttctggataccccgttaacttaaatttcattctatgtcaaatgaagacatgaactccattgacctccttgccaccatggtagatagcagaggcgaggttcatagctgttgtggcctttgagagtttatactaaagttagcaaacacacacctcttgatgaagtactatgtatttattttccaaagaaacttctattttctccaaagacaaaggccagcatttaactgttatataacacttttcaaaatggaccctaagaggagctgtcagcggtagtatattcctttacagttatgcagttctttgcatttttttttttgatccattatcttctttgatcctcttaacagcttggtaaggtagaaaaggcagaagttattttcagagtggcagtcggcctgtgtgcattgaggcagactgtagcaaaactgtgggtggtgctcaggaggcctgtcccctggactagcaatctttgctctccacaatgctgtctcctttagaaagtacagcaaaccactactccccacaaactttaggattttattttcttactgcagttgaagtaaatacaccgaacccactggtggcccttctgcttggcagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatgggagccaagatgggtggcctcttctcttcttatacctgtatttcatatcaagtgagcttaggaggattatatttatgtccatttatatttatgtccccaatctctaattcaattacattcaagatatactatgttatatattgggagaaaggatacaggggattagcagaatgtaaagcaggaaggatagtaagtggccacattatggaggccttgaatagaaagctcaatcatgatgttctccacatgtgtacttaacgtttttacttatgtcgtttccatctgtctttactgttctaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 867 - DNA, 665269 bp, Homo sapiens
ggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatgcctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattattggttcccagtgcatatgaaatttatgtttacactatactgtagtctcttaagtgtgaaatagcattatgtctaaaaatacagtatacataccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgacacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggtaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctttctctttctttctttctctttctttctttctttttctttctttcttttctttttctctttctctctttcttttctttttctttcactctctctctctttctttcttctgtttcccctcccttccttcctcccttcccttcccttcccttcccttcccttcccttcccttcccttcccttcccttccctcccctcccctgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctttctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacatgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttatagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgaagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttcgctcagactcaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggatttttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgtcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaagaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatctttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaactttttttttctttgaaacggagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccccccaccctccaactctgtctctctctctctctctctctctctttctctctctctctctctctctctctctctgtctgtcctcctctcctgctgttgccatgtgaagtgcctgctcccttttgacttctgccacgttgggaagcttcctgagcctccacagaaggagatgctgctatgtttcctctatagcctgtagaactgtgagccaataattcaacaactcaaccacttcttttcttttctttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacccatttcttaatctctctaagagacatggactgtgttaaagtgtgtttatgaactggtggtcgagggtgcatttccctcctaagaaaactcattccttgttatgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttattctccattcccatgatttagccctctaacttcatgcatttctttttgccctttttcttgtgctggattttagcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacacgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacccgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaatttgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagtgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttatatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttctgaaatttaaaatgggcatctcacttctgtgttccctccccaaataaatgtattgatactaaaaaggaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttatttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagtggaggtgtaaaaactagtcttccagcctccagtcctgtctcagcattgctccccttcacgtcgttgtccagagctcctggtggagccttggccttttccatatgtacacgtgcacacacacacacatacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctctctctccaccccccaccccccacccccacccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggaggttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttctctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagcgtcctgaccatctgtttctttctaccccaggcccattcccatcatgagtatttattctgcccagtgtgggatgggttctgttctagaagtttgcatgagcagagggaagcttagccccatgaggccagtcatgaggctccatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccgttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccatttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagactttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattctcagggagtttagagacaacataatgaaggtattttcaaggtttggggagctgcttggaacttgattttggacaaaatggaaggaaaacaaccatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttgtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcacagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggtgtgcaccaccatgtccagctaatttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttctctcctcctcctcctccttctcccttctcccttctcctttctccttctcctcctccctcctctccttctccttcttctttttcttcttcttctttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacagaaagataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaattttttttttttagttattcttattttctaattattttatatgctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttcttttttttttctgttttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattgaacaatgagaatgcttggacacaggaaagggaacatcacacactggggcctgtcatggggttgggggacgggggagggatagcattaggagatatacctaatgtaaatgacgagttaatgggtgcagcaaaccaacatggcacatgtatacatatgtaacaaatctgcacgttgtgcacatgtaccccagaacttaaaatattaaaaaaaagaaaaaaaaaagaatttgcatctatttttagactttctgttctattcatctgtcacttcatgtgtcattattatgctttcaattattgtagctttataatatgttttattatctgacaaagattccccattcctattagtttctctttttcagaaaatttctggcttttaatgcctgtttatttttcattgacctttataatgaacctatctagttctggctgggcgtggtggctcacgcctgtaatcccagcacttcgggtggctgaggtgggcagatcacttgaggtcagaagttcaagaccagcctggccaacatggtgaaaccctatctactaagaatacaaaaattagccaagtgtggtggcgggcacctgtagtcccagctactcgggaggctgaggcaggagaatcgcttgaactgggaggtggaggttgcagtgagccaagatcccgccactgcactccagcctgggtgacagagtgagactccgtctcaaaaaaaaaaaaaaataaaataaaataatgtaaaaaagttctgttgatatacttatgaggtttgctgggtttatttgttagcattacatgctatacattgtaaaaatgttgattctttttcttggaatactaatgcctttccatttgttgaaaccttctttgatgttcccaggagcactgagatttttcttcatgtagaccgtgcctgtttctaataagttaattttgtagatattttctacttgctctagttaatgtaattattttctatttcatttaattatatgtgtgtgtgcctctgtgtttggggtctggatttcagtacattgattttctgctcagccactttactgaattgtctcattatttgaataattttagataaattttttttgagtttctagttaagtaagtatattatctgccaataatttatcctttctttccaatttttacaacacttatagctttcttctaactgtactaatacctctagaatagtaaatattaaataactgtggttgagtaaatgtccttcttttgtgtctgagtttaatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaacatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaaccatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggaggttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggaagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaaaaaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagtgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttaggcatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaaggccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttaaagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctaactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagtctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcgcaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgttttcccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgttttttttttttcctttggatatatgaccagcagtgggattgctggatcttacgatatttctttcttttttttttttttttttttgagacggagttttgctgtgtcaccaggctggagtgcagtggtgctatctggctcactgcaagctccgcctcctggcctcctgggttcaagcgtttctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtggttttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcctctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggaatggtttgagacataatggtcattgtgatttttcaagctataaaataaagcatgatgttaaaagatgattaatgttttcatttggtggtagatgacaagtttcttgcagggcatctgatcaatcatgctcttttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgcgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatatatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaaacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacccacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctagtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcacgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcgaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttattttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctaggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttctttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggctttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactctcacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcaatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagaggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttttttttttttttttttgagatggagacttgctcttgtcgcccaggctggagtgcagtggcgcgatctcaactcaccacaacctctgcttcctgggttcaaacgattctcctgcctcagcctcccaagcagctgggattgcaggtgtgcaccacgacacctggctaattatttttgtatatttagtagagacggggtttcgccatgttggccaggctggtcttgaactcctgacctcaagtgatccgcccgtcttggcttcccaaactgctgggattacagacgtgagccactatgccaggccagttgtgggaattttataagggctttttcttttctttttttttttctccctctggcctagtttgtggggagaggtatgtttccccaaagatgtggagttagcctgttgatgtaggcatgggagagtgagcttagacagagatgcctctcatataaggtagaaagccttccatgcccaacccaagtgttgtagaagttgaaaggggaaaaaactttttcaaaattggcttgacagcaaaactcctctcagtgtcttcttttttgtccccctctataaatggtaggttttcgtagtatcatgaccctttttagtaattataaattaatataagataaatttatggtattccttactatatagatttgttaaaataattcacgatatttcatatgtacacacaagctccttcaatccaattagtaagaaaaacacttcatgtcactgttaaataacatgaaaataaacaactggttaaaaaacaaaacccaaatacaaagcgttgagcttcctactggaatctgaatctgggagtgtcttgttgtaagaaatgttttcagacctatcattttcttttgtttctttttctttttttctaaacagactcttgtcagttctcttctgattagtgttcccctgggcttttcttcccaaaataaagttaagtgcattcaagtttctgggatcttctttacatccttttgaaaatgcagagtaaatattatgttggcttctttttgttttttttttttaaattttattattattatactttaagttttagggtacatgtgtacaacgtgcaggtttgttacatatgtatacatgtgctatgttagtgtgctgcacccattaactcgtcatttagcattaggtgtatctcctaatgctatccctcccacctcccctaaccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaactcatcatttttatggctgcatagtattccatggtgtatatgtgtcacattttcttaatccagtctattgttgttggacatttgggttggttcgaagtctttgctattgtgaatagtgccgctataaacatacgtgtgcatgtgtctttatagcagcatgatttataatcctttgggtataaacccagtaatgggatggctgggtcaaatggtatttctagttctagatccctgaggaatcgccacactgacttccacaatggttgaactagttcacagtcccaccaaaagtgtaaaagtgttcctatttctccacatcttctccagcacctgttgtttcctgactttttaatgatcaccattctaactggtgtgagatggtatctcattgtggttttgatttgcatttctctgatggccagtgatgatgagccttttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagtttccccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcgtctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtgctgaaaaaaatgtgtattctgtcgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgcctttttttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgagagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcggctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcattcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcaagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaaatagcatttacattttggctcttgaaataactaacagcatgtcatttccaaagagacgttaatcattgataccaccagcagcaaatgttctcattcatcagaccacatttgttttacacgttcctctccttagaaagagataagtatggtttcttttctttagttcttgctaataggatacccaacatattgaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtagtgtatgtatgtgcatgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaattcaaaaatcagtcaggcatggtggcacatgcctgtaatcccagttacttgggaggctgaggcaggagaatcgcttgaaccacgaagtcggaggttgcagtgagctgagattgcgtcactgcactccagcctgggcgacagagcgagactctgtctcaaaaaaaaaaaaaaaaaaaaaaaaaaaaaaaaaaaatttcagaagtcccggagtcctttccatgatgcatttgaagggccagagagatagaggcatgccctatgtagtacatcttgctgctgtccctcgtgtgtttaccctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtgcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcgtgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggcagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacatttttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagtcttagtattttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaacagcctggttcatttttactgtgttgccattggttaatgcttaaccagattttgtctctgtttcaaaatcttgaaataaaagtggaacaacttccaacatgacttaagaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccgttaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataataatcaaggacttagaagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggttctctatgaccttttagctcttaagtagtctgtcctggctattgtcaaccatgtctttttttccttgactgatagaaactgtggcaaactaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacgggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagccaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgtttaaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctacgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgactgtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcgagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttgtatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttccttggagaagttagggaaatgttcacagagttagagacatttgagctgagacaatataaaaatatagggcttggtagaacgtgaagagagggaaacggcattgttgatggtgaacacagcatgagcaagggttcagaatcatgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctccggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggcctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaacgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttttttgagatggagtttcactcttgttgcccaggctggagtgcaatggcattatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataactttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggcggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggacaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaattcgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacatactttttgatggcattgtttgtttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaatgcttttctttatcaatgttgaatattggcccccattctcttctggcttgtagagtttctgcagagagatctgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgacctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaatcctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcattacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcatatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattcttttgtagtgttgcttacgttttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcccaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatggtctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcctggcagggttatcttacgctattgaacctcagtttctccatttatccaatagagatggaaagtattggcctgcatttatttctccttcaaatgacatattgtatagaagcgtatcgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgatttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattacaccatagcagtccagcctgggcgacagagtgagactgcctcaaaaaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcacatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagacagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgaatacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctgtgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaaggtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacacttcctttcacgtttgtaaactagttatagatttggtacatgtagtcagtcactgtgctaaattctccttaagaattacgtctcttttttgaaaaactaacttttaaaatagacattattattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccatttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttgcaagagtccaatgctgcataatattaataaacttaattttcttaaattttcttctctggcagagaccataagcagtatgatatttagtcatgctaggataagacctgagtagaaattgtactagctatccagctcgtttgttaatttacttttgatgaggcagagaacggtcatttaaccagcttttgttcagtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaatattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgatgagtgggttgggattaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatatgctgtgtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtacgatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaacaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtaaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacattctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatataggtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacgctccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacatacaggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatgcagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcaaactgcctggcatggtgcgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaggctactcctccataaatagaaaagatctcttctccaacacatcaaaaacattatttttaataggaaaataacaaataaagaacaggttaaaaggtagaagtttctgtttccccaatacagttttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaatggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccgtggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcagcagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggtaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcatttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggatatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacgcggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtgctcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatcgttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctttggcttttccacattaaatttctcctcttggtttatttttcagagtactctatgacctacctcatcctatgtagcacactgtatctcccactgtcctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgtttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccctgccttcctccctcccctctctccctccctccctcccttgtccctcttgcctgaacttcatatcagtgtgtcttgaatatttgaaaaatatttataggaaagtgaatgaaacctatcctaaatggagaagtagatggcaaaaaagggtattagagcttggcttttcaattgtaattgtagccatgacctaatttttggtaatctaataggcccatataatctctgcttggtgttagaagggaagacctttcaccttttgtgttttcttcctaatgtcatgcaaagtgctagagctttggagcaaaatgtttgatttccaaattccaattcttccatttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtttcaatgagccaaggttgcagtgagtgccattgcgctctagtctgggcaacaagagcaaaacccggtctataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggtgttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgctttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgaggctctcatcagaaactgtctggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctctttccataaaatgatatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacatggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagaaggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacagttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagaaatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccgtccgtccttccttccttccttccttccttccttccttccttccttccttccttcctctctctctcttctttctttctctttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaggtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttggagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatctgaaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggttgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttgtgtgaacctgtccatgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccaagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgcgcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaagaaaacagaggactattatgttactatttcctaaataaagaccaatatgataaattccttatattcagtgagaggaaagaagttgcttaccgaatgtactgatatatgcttccttttttcagaaaacaacaacatcaaccaaaacacctgtataattattacatgaatttttttttttttttttttttttgatatggagtttcagtcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatgtcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgggccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttaaaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtaggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaatattggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttatggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacacacacagacacacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttaattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatatgtgtgtgtgtgtgtgtgtgtgtgtggtatattatctatttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgtgtttttttttgttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaataactaccataatttaaaaatgcaaatgtagcaatgcactaaaaaatacctttagcttattttttgttaagaaacaagtgttttgcataatcagactttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctcctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaacggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggctttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagaacccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaacatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagacacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcgtaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgtaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggtcgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtggttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcacagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaataacaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaaattaaaaactattacattttttctccctcccttcctttctactgtttccctcctctcctctctttggtttccttccttcctttgttccttcgttccttcgttccttccttccttccttctgtccttcccttccctccctccctccttcctcccctcccctccccttccttcttctttcttgccctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcacttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgcttttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactctcattgggggttgggggggttgggggtgggctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctacttgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaactaggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgtaatatgtgacagttccctgggagtttctcccctcctcgtaggtatttttagcaaaatagtccttaaacattgttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttacaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgattttctgtccttttatatttcctccttccctctgagggttcacataggagcctccacagccagaggattactttcagaattggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaacgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcattttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcactggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaattccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatatacacacacatatacatatacacacacacacatatatatagcattcttaatctcatatatatataatatatatataatatatatatattatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggtttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctcttggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcattttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagctctctttggagatgagaagatttttctcaactttattatgaattccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttggtctgtatatcttgtttttcatgccagtaccatactgttttgattactgtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatatcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctaccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaccatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcaataccagtaccatgttgttttggttactgtagccttgtagtatagtttgaagtcaggtagcatgatgcctccagctttgttctttttgcttgggattgccttgtctgtacaggctctttttcatttctatgggttttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaaaaaaagagagagctaacatcttcactttttaaggaaatagacattgcccccatgattgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatactttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcgaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttccctttccctttccctttccctttcccttcccttcccttctccttctccttctccttccttccttttccttccttccttccttccttccttccttctctctctttctctcttctttggtgtgctgagaataatctgcagacagtgactctacagataagattgcaaatattttcccttccttcattccttccttctttcctcccttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaataaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcattgtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagaccccatgttgaagaataagatacatatgctgatgtctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaacctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccatttctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggattgccattaaaataattttgtgcagcagcactgtgaggactcagaatccagaagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcaggtgcggtggctcacacttgtaatcccagcactttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgtaggagtcaggttgcctataaaggcaaggatgtgcatacagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacaatctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggtttttttttattattatataaagccttgcagtgagtcatagaagaaatgcactggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaaaggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataattcataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagatcctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccatttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagtcgtcttgagacaataggttgaagctttcactacatgttcttttagcaaaaaattataaagcatagaggttgagatgggctctggaatcagactacaaagattctgatcttactgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatctctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacacaccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgttaaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcagctcttaccagtgacttcagtgcttccttatacaaggtgcaagcggtgctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggcattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcagatatgtgtcatcttaatattcctattaaccttagaactttgtgactgtgttgggattacttgacatatttgtttatcaatcaacacagtgacagtgacaacgaatgagtaaccagtgttttgtttttgaaacatttgaagaagtgttccatatttctgaagttattagtttagtttaggttagtttagtttagtttagttttaacgacagagtcttgctctgttgcccaggctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacatcatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttgaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactcttggtgttgtacatgttgtgggctttgatgagtgtgtagcatttatttcccgtcatagaatcatgcggaatactttcactgcccctaagaattatccttgctctgcctattattactttctcccccaaccccggtaacccctgaaatttttactggcttcatagttttgccttatcagaatgtcttatagttgggaccctacaatatgcagcctttccatattgccattttactgaataatatacattcaaggttcatccatgtcttctcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttttgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccttcttcttcttcttcttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttggtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggaacagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccagcatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaagcaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacattatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgatgtgaaaacttagcttgtccagccaaactggaggaaggagaggcgggacttattggagtaactgaaaagagaaaaattggaatatgagcagtaccaatactcagtctcttaaggaagggtagagtccctttctttctgtctctgtaatttttttcttttttgtttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcaattggttttgttaacactgctgcaccgaagctctagctgaattcacataatctcatgattttagtaaaggtaacaaaggaaaacgattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctcccacagcattagccttagttatgagtataatacaaaagaagaggaccagccctgctggaaggtaaatgaaaagatggaggaattgaacgattacataacagctgttcagacttgtggtactgattagagtcatttgtagagatgaagcagtgtgtcaagccagtgtgggctagggtatactgggaagttctcacagacagaatgaagtgggttgcggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgtgtgtgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaaatatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatggcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttccctttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcatcttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtaacaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatacgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaatactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcagacatatggagtttcaaactaacactgtggtaattgttgtgtgtctaaacaagtgacaacggggctgggcagcaaaactagacatgggagaagccaactgatccattgagctgtcccagcaagagttagtgggattatgatttatgaaagacctgtgtggacaaggtagtttggaggaactgaatggagggagtgaattaattagaagaatgagacaggactagccacaaacttctcctagaagtttaaactattttaaaaataagagttgtggctcatcaaaaaagtagtgttttcaaaaaacacagccccttcacttaaatgatacgcacagtccagatagactgcaaaacttaatgtttagaagctaacaactttttaaaaactttattgatctgatctgtactgagaacagattttctctgtgctttataataaaacataaagatcaatcacaaaataatttatcaataaattttaaaacaaaaattttaaagtgtatgtaaatatcatataaaattaagaaaaaatatgtaagaataatatttgcaatgactatgataagcaaagggttaacaactgtatgaaaattttcatgcaaatacaaatatcccaacagagaaagacaaggaatgtaaataattcttaagtagataaatacaaatggatatttaacttaaaaaaaattttattcacattagtatgaaaagaaaatttaaataattgaaatctagtttttcacttatgaaattagcaaagatttaggaaaagaaactactgtcatttgctgctggtaagaccgtaaattggcccaaaacttttagaaagttattttacaatatttctcaagaactttaaatgtctcatatctgtcaatccagacagatagatggatggatggatggatggataaatatcagatggatggatggatggatggatggatttatcagtaatagatacatagatggatagatagatagatacatagacatctatagagatatatgtttctatataaatatatatctatattatcctaaagaaatatatatttgaacaaaatctatttatgaaaatgttcactaatgcaaaacttataatggcaaatagaaagggaatctgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtacttcccaataatcagattacatgtgattttattttcccccctaattttccttaattttcaagttccgtacaatgaacatgtgttattttcataagtataaaagacttttttataaaaagaaatatatagaactaattagccaaataggaaagtttctaagaacaagggaagaaatttgtgaatggagtggtgaagagatccttggactgagagctgggcaatgtggatactaacactggctctgtcacaaagaaacaaggagacttattgaggttctctcttctggctcaaagattttatgagccagtaatttatcaaagagcccatcctagtgtacccatgggcctgtcaaccctggtagacaggttagtagcccagatgaaatttcccgtggatgaattttagaactccgctccattgatcacccttttttgttgttgttgttcttttactcttctggaagagagctaagaaacttctgataccatccccctttcccactcgccctcagttgtgagatggaggcagcaaatattcagtgtgttctttttggtcttaagtagttctagactcagataccacctcagcaccaggctgagtttgggctggctttggctacggtttgctgctgaatgtatcagtgatggacttttgaatgtttaatagccttagggaatgtggcagtgtcccctacatagagaactgtagattctttagtccaccatttccaaccctgtgatttagattgtcattataagcatcacaggatgccctgagttgagaaaaatctgtgctgtttaaatggtctttaagcagcctttcctttctcctctttctcagctctattctgcttaggatatggcttatgccacttaatcaacatgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgcgaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctctttaatttactgtggttatattatatatgtgcaatggatccctattttcaaacatagtcgtttgataaagtgtgggctgcttttcatcacgaatgtaaaaagtctcttagttgctacacccagcaactaagtgtcctttaattcttaactttgaatacttaattggatccctggtgctatgtgtatttgatttttgttgtgaaagttgcattcactgtgtccctttatttgacatcagcaagatgtaatttctataaaccaattaatgatgcacctttcaactcttactatgagaatattagctggtgtaaatatcggactccttgtgaaggatgactcgctatctgattggtctttaaaaaaatactttaggaaataatggcttgcccctgcatataccaatttgaagtctttctaatatcagccattagctgggatccacatggagtacatagacaaatgaccatagtttctactgtaaaaatgcctcaagatcttgtaggtgagattaggcaattagataaatgcctatagcacaaaatgaattaacatgattgcttgaaaagaattaatttctgtaataatttgaagaaggaagaagttatgtatgctttggggggtatacagaaaggctttataaacaaccctatgaaaaaatggaccacagttttaaacgggcaatccacagaagggaaacactgcaatattcattggaaaaagaaaaggaaggaagggagtgaccaagagaagaaacaagaaggaaaggactgaaatcttgtttgcctttttggagaagatagcatttgaaatgggccttggataataaggtgtgattgtcgttggtggaaatgaattgcatccagaatgcagaaataactcaagcaaaggcatagagattggaaaacatggggcaggtagaaaacaagtccagagtctttgctgcttcttagaagatgtataagggttttattttatagttttataatgaagggcttttaatttcaagtgatgggtcagtgtataattccttaggagataaaattccagggaaaaggaggaggggttataagataaatctagaaatctaactcataaaaattagttcccttccagggagttagttactccaaaaatatccttgataagctaactctgcatggatataactgtgttatctgtgagctggctacagacaagaatttacaattgtctgtagttgcagtctttgagctgcagtcattcaatctctgtctactgctaaaagccagagtttggaaagagcccttatgcatgcttgataatgacacaatttgactgagaatactgccattttataataatctctgaaagttacttccttggtctactgaatctcatattttgtgaagttaaatgaccaatgactgtcattcattggccatgattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagattacttcatagtgaaacacttaagtttgattcttatgagttgcaaaatgattttccaccaggaaaaataaagaatatgggttccatcaaaagtcaggcatgaattctcatctcctgataaaatgtgaaatatctttgctgatcctgtgcctattctcagtttccatgaccatgcacaattattatttttagcaaataagcaaatttgaggcaaaaacattaatttgataagatatctgcaaatgcctttctggaggagaaaataaatttaaaaagcatcagtgtgtttcactgatatgcacaatcccccacttcttataagaaattaaaacactagtttttaatatcttcagagagaaaatgagtaaaggaagcacagtattttccgaaacgtgttatttaaactaaaaccatgaaatttatgaaaaaaaaaaaaagtagacccttccttgatacacttggtcccaccgaggttcaaagtttcctttgaattggggggggaagggagattctgtaatttaagttttaaacttctgtctttgtatctatccttgtgctggtactccgctatcttggttgctatggttttagagcaaatcttcatatcaggtggtctaagttctccaactttgttcctcttttccaaaattagttgaactattgtgcatcctttatatttccatatatattttagatgtggcttgtcaatttataccaataaaggattctgttgtacatgtaaaccaaattagggagaactgacactttaacaatattgtctttcaatgcatgaacatggtatatctctccctttacttcatttttttttttttggttctctcagcagtgtttttaattattattgtaaaggccttgcacatattatggaacaaacacatattatggaacaaataaatgtaaaagctaaatctataaaacttttccaagaaaagaaaagaattcttacaaccttagataggcaaatatttcttaaggagtatacaaaaaaccccacaaaccataaagttaaaaatgataaatttgattttataaaaactctaaaacttgttttttaaaagacaccataacaaatgaaatagcaagtcccatacagggagaaaatatgtgtacagtatgtgtatatgacaaagattttatgccagaatatagaaataattattaaaactcaagaagaagacaaagaatgcaatttaaaaacaggcaacagatttgaaaataggcaatagatttgaacaggtacttctctaagaaaatacacaaataaccaataagcaaatgaaaaatgctcaatatatgtagtcattaaagaaacaaaataaaactctgtaaggtacctccatacattgatgagagtggctaagactaacaataccaagcattagctaaaagacagagcaattgaaattctcatacactgcagttgaggatgtaacatggtactgccactttggaaaacagtttggtagtgtcttaaaaataaaacgtgttcaacatatgacccagcaattctcctccttgacattgacccaagtgaaatgaaaccttttttttacacaaaggcttgtacacaaatgttcatagcaactatatttataatggccaaaaactggaaacaacccaaatgttcattaacaggtgaaaggacaaattatgctatatttatacaatgaaagatgactcatcggtaataaataaatgatctgctaatatgcacaaatacatgaaaaaaatcttaaaaatatgatgctgaataaaaggaaccagagctacctccacccctaaaaaagactgcctaccttagaattatatatttacaaaatcctggaaaagacaaaactaatctatactgacacaaagcaatcagtggtttgctgaggctgggagtggggaaaggattgattataatggggactgacaaatagggaactttttggggtgatggaaatgttccagatcctggtaatggaggcagttacaaagtcttataaatgtattgaaattcatcaaagtgtacagttaaaatggttttatttattgcatttagattatacctcaacaaaggtggttttaataaataaacaagaaaaagtgtttttcaccaattggtttgaaattcggccaaggcatatttgagcgagggctgtcagccttgtatttgttgcaagtcacagtgagtatgtcctaatggatcctctacaaggtccaggttaggtttctttaaaggatggcaagaacctgaaacagtgtgagtgcagagaacagtgaaacagtgtgtgtacatagtgctttgatttttgtgcattttttggtcctaatattttaaagtttgctgaaccatacctcatagaacatttacctgctttttctgagggaaatatctttatagaacttttccaaagcattctgcatagattttattttaagaaattaaaacattttatttgtattaatttacataataattggttaactcacataattacaatgacaagatcatacagtaggagcagacttgggatcaaatgcagctgactctaatagcaggtgtagcaggaggcacacagctgaggggacatttgagacgaaattgaggccaggttccacttcacattgtactagggttaagcgtgtccacccagaggaagagaatccttaggcctaaaagagcaaaagtgtacagacatactcaagagtaagagagtagccaggaacaccagccaagccataaactccagtctgtgtgtgttaacagataaaattaagagggtaatctagggagtctattgctaaatgaagggcacattaagtctcaacagtattcctatgatcaatcaagcaaccaatgaagtgtacaagcagaagtgatttgtcatggaatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtggtaagaggccagttttcccatcctcatttactctaaatttgattcatagattattgagcctcagatatctgtttgccatctggtctggtcagtctggtttggcatgcgtcttctttctctttagagtttgatgacgttttaggctgtgaggggcatttgcattgtagtagaaattggatgatgtcagacttgctttatcacactttctcaataatctcttttggtgagtttgatattctacttacagctgctaaagctccttataaccatacgcacaaacatacacttccatatagtcatacatactcacaaacatatatacacagccatttacttacacacgtgtacacaaaggtgtatatccacacacttacatgcacaatgagagatgcatagtaagaatttttccactacccctagtttaactggaagctgtagaaaatctgaactttattatattgatctctgggatcatccacaaaattgcccaaaatgggaatgcggaagctgtttcttacctttcattttctccacatccaatgtgtcctcttcaactgtgtattttgaaacaacctttgaatctgtccccttcccgcaactgcactgccaactgctgatatcattttttgcaaacaagtgtaatgaaaagagcatattctttaacatcaagcaaactaaggtgcaaattttagctctgcatgtattcattgtgctatcttggacaagttatttaactatcctgagcctccttgtcttaatgtgcagatagaagaagataatgcctacctgataggtggcataggaaaaggtcaaaaacattattttctactcccattgctccccttgcctgaaacattataatggccaaacaactggcctcccaacctcctttcccctcttcagtttttcctctacattatagctagagattttgctaaaatgtatatatggtcatcccattttttacttgaaactggtatcttcctgcctataaaacacattttgtttcttagtctcacataggaaatcctttttagtctgtcttgggcccaggactccagtccgattttcctcccattcctacctgccctcttggttttgaatgttccacacaacttcattcctttctctgttaattggcttttcctttacttagaatgctttcccccttcctgctttttagggagaacagggtaaactgttctccctatccttcattgagtctcctttcttttttctaaagttttttcttatcagcatccctcccccaatttgagctcattttctagaaagaattaatagctttcttatatgactctcaagatatttctgtgtggttctctaacagccttcatttattttatatggtaattatagatgtccatttgttctagggaaggcaggtgtcaggtcttactcatctttatattcctggtttgacatacagtgcctgatgtctagtaagcacttgatatctgtttattttaatgtttatgccctacattatctatcacaagtattaaagattgataggtgctctgtaaatgttaaattgagttaattattttcaatcttacaggaagttacataagtcattcctgtattcatttgtgaattttcgacatcctatattaagagttgcacttagaatgtgagttccatgagggcaacagcacttctgtcttactgctctgtctgctatgttggcccataattaaccactcagtaagccttttgtgaaaacaacctcaatgagtcttctacctcaagtcttttgaataggaatggatttaaagctgacccctaatacatctttcaaactttaagtcagtaaattttttacaaacttttttaagttgataaatccctcagaaattattctgaggaagctgatgggatagaaatgaaacagactaaggggctccaggcaatcaccactccccttcgttctccttcctctgttggtggggatcaatagagcaggatcctcaaaactgtggagttctttggagcatactttgaaagcctctaattctattccacgctctaatttccaaaagagggaactgaggcccgtggtggttaaatgccctttccgaggttacacagctatacatggtagagccgacccatgtcttctgactctcatcccgttgcacttacaactagcctgcatgttccccttttcccatatcgcatggatagcatcttacgcatctaagtttttttctttaataatgatcttctcttttctttaagagacaccatcactccgagttgtaccacttgcaccaggctaaattattcctcagtgtttacccctttcagatatttatagaccatcattatggcactccctagtcacctgtcagcttcctaatatgtacatatatggtttctttaatctttctgtacagtcggcttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgtaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttactgagcgtatccatttttatgcagtttctgtggacttacatggtttctgggagctccctataagccttagtaagggaaagctcttgacttatctcactagttattagggatttggatatatgtttactaaatgtgataatctaagtatggaaactacattagtacaagaggaatcacccagaaatactctactggcataaataaaacattacctattgcccagttttctcatttgtttcattttgtaacttttataatgtgtcaataagtttgaagtcttgaagggctgcccagaaaccaccacagagtggattttccttaccctcaatctgccttcatcaaaatttagtttgtgtgtttatcctataaaatttatctcataataaaaactgaagactaggacggtccttagaaaaacacttgattcggtgtatttattttataaaagggagtcacagagagaaaatgtggccagctcaggtacatggcttcctaggcaatgttccatttcgcaaaactttcattggtccagaaagtgtaccttcattcccaaccaaatccttcctataatgctttccatgcctttcttctgtggctctctctgatgatctcacaggtctataagctcttacaggtagaaatatgatttcttgctgtgttcttattataaagcattgccatgcaactgagaagtaatgagagccagtggattttattagaatggaattttaacttttctactttaaaacccagtgattctgctagtctggaggtagcaaagaaggatgactattttctctctcacacaaagtaagattctgaaggggcttattctctgaatgaaaaacgagaggagaaaagtaagaaccttctaatgttttattcaaatgttaacaaagaaatttgagaagcatgtttccttaaaattgacaccatttttatcccaaacattctggtaagtgatagcagatgactgtgcaagcttctatggagagagagagaggaatttttccaggagcatagtcccagtgggaagtattacctaaaagtaatacactaatcactttcaatcttgcatatttccacatactgtgtgcacacatatgtgtattaataactgttccctagacgtcacttcagcgctcagacagcttagtgttgctatgcgaatgctggagatggaatcagatgcagactacagtttagcaatgagaattcttcagagatacaagaatggaaatggccttaggtcctgcctcatgggtctccctctgagctccagtgtaacatcgggtgtcaagtatttgtggccccatctgcccactccactgagaatctaaatggcattgccagtatttgtgaggtactcatatcttaaaagtcagtgtactcaaatcagtcttgcattctaccttgtggattttgcatggaaattttttagaatgtcattgctgatggaagccccagatatataagtacatctgctccatcgtactggtgatttttatagatattcataagaaaatttattttacagcagtttattttagaggaattctttgcattttatttgtatgtgtgtatacttattttactggcaggatacacacacatgtatatacacacacacacatacatatatacacatacatacatatatatatgaatgtatgtttgtatcctgtcagtaatactttgaggtacctagggctgagattactatttctcttccacctatggctcaaatgggtaaaatagcttactcaaagtcacagttcatacatgtggtgcagcttgaatcaaaactcaattcttctatccacagatttaccactacttgagtagtctgtggtgtttaaaaaaaataataaacaacaggccgggcacagcggctcacacctgtaatcccagcactttgggaggctgaggcaggtggatcacaaggtcaggagtttgagatcagcctggctaacatagtgaaaccccgtttctactaaaaatacaaaaaattagctgggcatggtgacgtgcgcctgtaatcccagctactcgggaggctgaggcaggagaatcacttgaacccgggaggcagaggttgctgtgagccaagattgtgccgttgcactccagcttgggcaacaagagcaaaactctgtctcaaagtaataataataataagacgaagaagtaacaaagccaaactggaaagtttctgttaaatgaatgttctagataataccaacgtataaagcaatcattttataccagctatggtcaaacagggaccagagccttgacttttttttgcctcaacacagctctgcagaacccactcagtaccccatgtcctactgccattcctttggtttccagaacattgagatgtacaaatccaaaacaccacagtgtttcagagagaaatggcatgactctactggttgcaattgtaatggagttcaccttgttctggagtcatacagaagccatgttgtagacttagtgtcccacgcaatactcctaattacaatgaaaatctactgttaggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttatagagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatggcctgatcaacactttttaataaaatcacaatatctactgctgaattttggagggaaccaattcaaatcatagcacacatcttttctaaaatggaaagggtaatatgatcattggagaaatactcattcctttgcatattggtttactatccaagccaggtgtggtggttcacacttgtaattccagcactttgggaggccgagatgggtggatcacctgatgtcaggagtttgagactagcctggccaacatggtgaaaccccatctctactacaaatatcaaaaaattagccagccatggtggcacacacctgtaatcccagctactcaggaggctggggccagagaattgcttgaacctgggaggcagaggttgcagtgagccaagatcgcaccactgcactccaacctgggcaaccgagtgagactccatctcaaaaaataaaaaaaaaagtttactatccagagaatcttgtccaggttaacactcttttttgtctgctttcttcttttgtgaaacaagaaggtaagagggacactggagaaaacctaatgttctttacaaaatgagtcatagttctccatctgcaaactgtggctcccatttatgtcttggtgtcaatatgactattacatgttatgtacatggattccacctcatttgcaacatagtcttctgcctgagctctgtttgttggatctgatctaactttacatggtcttaagtcacacattgaactcttaagttctgtaggcctctaagcctttttaagttttagtattttcatcgttaaaatgagagtgattataacccttgctttgctgcctccaaatattattgagggatcaaatgcattgataaataagataaagcactagacaaatataagggatgcttgatgacttcacagagggaagattattctgttgctggctgctgaaatacagtagctttagaaaaacccctttgggttcccttattatcaggtttggtctcaaataaccagaataaatttggagatttcctaccacaaaagctaaaagtacctgggcagatttaccctttgagtggacctaagggaaatgcagattcccacgggagagatcacggagcagattcaaaccataaggcaaaaataattgttgcaatagcggttctaactgtactagtaaatattgatttttctgttagcagatcaatcatgaaatgaattctaaatatagaagactggttaaaaaattaagacggagaatgtgaaaatgtccatgtgtaaaaattaacttaaagagaaatcttgctttggccaaaagaaatactactgtttctgtcaggaatgttctgtgatttaatcaagtttcctgcctggccagataattttaggaattgtggacttttaaagtagtaagtcagtttagaaaactggttaagtggacagatgtaaagtcagactgcctaagccccaattccagcttcaatatttaactctgtggttgtgggcaaggcacataatctctttatgctgccttttcatcaactgttatggagataatgatagaacctacatcatagagttgttggggtgactacatgagataatacaattaaatacttaacacctggtccataaaaagcgctgaataaatattgactattatcatcaccccggggtctacaaatttttgtaggattaggattaggattgaaatttctaccgaaaaattccatcagtaaaatattgataaatataaatcttaaccaactgcctcagagacatagggacctctattttccactcattgactgtcatctttagagaacagtccaaagcatgtgcctttctgttctagttgttatgagctctttattttgaagttgaactatatacttcctatagtttaaaggagaaagaagtaggtctcatgctggacaccttctagatgttacctcctccgaatttcatagccaagtatttaaggcagttatgatcatctccctcttagagaagcctagaaaaggttactgcagtgcttgacagcaaatagaaactcaccaagtgcatttgttgagggattgacagaatggctggataagtgactcaactaagaccacttatctagtgagtgcgtctactcagctgcttgttttgaagacaaggaaattcgggctcagaaaatttaggaaacttgtctaggctgccaatagctagtaacaaaggcaagaattgcatatctgattttctttacaccatgttacatctaactgttcaaaagataaccatgtattatactcgaaaatgcaaaacagggttgttttttgttttgtttgttgtggtggtggtgatggtatttttgttttgtttttgctacttttcctgagagtggaagttgttatcaaaaagttactgtcatgactactatgtgtatagatgctattagtttcatcaaggttgggaatagggtatatgttgcccaactttctgcccctctccgcctcatattaaagttccagtttcctagaatatatctcctgggagatttggcactagccatcactgcattccaataccccgggacaaactactcttggtggaacacagaagcatacagtccttgttacagcagtggttctcaaactcacattcctgatggaaagctagagttgaagggtcaacacccaagagctgcagtggaggaccatcacctgtcctgattcgccacctgtggtagatcatgactttcactaagatcccctgaggcttgtggggatggagaagtgatgctggactggcccttcctctttccctgcaggtgttaatgggttctgctcctaaacaatactgatataggtcagagttatgattgaattgtatacatagaaacatgtgctgattgagaaaatgggctttacaagtcagacctggttccagtctcagccacactacattctgcctttgagactttggccaggtgatggaacatcaggtttcttatctaaaaaggagaataattggttggtaggactaaatgaaaaaatgtatgtgaaatgcttaggacagtgctgagcacagataaaaatgcacaataattttctattttttgttagtttccttcacaatacatatatttacatcagcgaaacatgcttgcttttgcaaccttctgtgggactccccctcctaatttaccacctcacctgaaggtctaagctaagcaaatctctgtctataaatgaatcacatcgtggttagactttataacaacttccccttgccaggagatcactcagccttcacttcatctcatctggtttgctgcccaggcctttatccactcattcctgaactcctctccctgacaaccttggggttttggcttgttgtgtgcgtgtgtgtgtgtgtgtgtgtgtgtgtgtgtgtgtgttttgttttttgtttttttttactttaccttaatttctctttttggactaagatgttaaaatgtttcttaatgtgactgtctccgaaactgttttgtgtctaccactcatcctagtggcagtcattgatccttttcttgttgcgagtgtttgagtgtgggtgtgtgtgagtgtgtatatgtatttgtagagggaaaaacaagagagagggaaacagacattggagccacctttcccccactagccacgtacctgttgaaccttcaagcctctctatagaatcagatatacacaagcacagtgacagaactacatgtgtcctacagtccagcttttaagatatgataaaaactcttgtattcacagagctaaatggcaataaccataggagattgcatattgctacattatgtaaagacagagtcccaagaaaatagtgagaactcagtttgatgtatgatgtgatatgtgatatcttactttacatggctaacagttgacattctttgtggattctatattgtctaaggctacagaagagccatatgataaattcatcggcaacccaaaagaagcctgttctatcgcagtgcttccaattaatataagtaaaccactttctctggctcaatgctaccaaaatattttatgagaaaatttagctgattctgctcatgtatattttcaatggatggaaagccattgcaaacttttcaaactaaaatataaagatagcattagggagaatactctctctggtgaaaaacaacatgtattatgatgcgttaggaatttctttttttcagccaactcgtggttgagcagtctgtccccaaactgttttgcatgcggacgaaacctgtttgggcgatacttgtcagcttttcttctgacaagcaggacagaaataggcacccccagaacactgagtttgacttgactcaacatagaatcacctggagagttttaaaagtttctctcctgtaatatcccacctccagaccaatgaaatcagaatctttggagttgggaaccagggatcaatatttttttttttaagtttcccagatgattgcaatatacaggcaagattgagagtcactgtcctagagtataagcagtttaagaaacaagttgtctattattacatgcatcaatactacagagtccatgaaataaaagctttggtgataagaaaatgccaccatcctagagccttcagttaacatcatatgggcctgtcatataaagaatgcaaactcattctgttatctttttgggccttcagtggaagataatttttaaatcagcttaatggaaactgtgcttcaggaaaataacttcagtagccatatgtaggataaactggagcaggttttgtttctaggaatatgttgccatcatttcactacccttatataatcttattgattcaacttttagaaccaagactttttgcagaatatatcgaagaatgtgcttaatgggaatgctgatatatcatacaattggcatatagagcttcagttcattatcatatttaaaggtacaatattaattttgcttgtgcttaaaatgtctattataattcaagtagcaaggaagacataaagaaaaatgtgacctggctttacatctgcacatatttaatactttacatttgatggtgaataatgggaaagtttgggagtatgtcatgctcagtcaccatgcatcaactcccaaaatggctgtggacagctttggtcctgcctcaaaacaagcactgcttgcaaaagagggtctgtggcttatttttatcagttgtgtggtgatcacaggaaaaacattttaaataaaaagtttattttgccatcatgaaagaaacaaattcatattaccaaaagagaaaataaatatgacaacccagcctggtgcagtggttcatgactataatcccggcacctcaggaggccaaggttggagggttgcatgatcccaggagcttgagaccagcctgggaagcacagcaagaccctatctgtacaggaaaatattaaaaattagctgggcttggtggcgtgtgcctatagtcccagctactggtggcaagggctgagggaggaggatcacttgagcccaggagttcaagggtgtagtgaaccatgatcgcactactgccctccagcctgggcaacagagtgagatcctgtcacaaaaaaaaaaaaaaaaaaaaaaaaaaaaaaaaaaaaaaaaaaaaaaaaaaaaaaaacaaagaaaagaaaacccatatcacgctatgccacttctcttgttcaacctgtagatttccctggaatgccactattcacccatgccatccccaaaaatgacttgttaaaattctaactcttcagattagctccattattaagacttctgtaaagtctttctgttggtaagaggaggtaaatcagagatatcagaacaatcaggaagccattgcaatagcctttgaaaggaagggtgattaggtagtaggcatgtggtggaaagcaggcatttctgacacattgctgaggttgctatagatgggagagcagaggtgaaggataagaagaattgttggctgaatctagagtcagtacaaagcaatatataaaataagtaataatatataaacaccatttttggttttgtttggaaatcttaattcactgacaaagttccccatcggctgccggccctctgtcatcggatcttttgattgactgactgctcagcattggcagcaagctcttcacaccagccctgggtctgagctaatcagctgtgtttccttcatgctctgatgccttgaagtttggtactattctcctggtttctcttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctagaggaatattctccaaagcataaagtagaagatcattccttaggaatacaatacagtccatctgttttcatagctgagaaggcaattccgtgtcatgccatcatggagccactgcagtgttttggtatccaagccatagtcactcattctctccgtgagggaaaactagaatgtcttttcctcttccacctttacctttcaaaattccatccttgaaggttcggctcaaatgcttctttctccacacaacctttcctgagcccctgtgagtgtggttttccttccacattccatagcactttcttctaagacgtgttacatgctttgccatgtgactattgcatgtaggttgtcttgactgtgagaggcactgacatcgtgacatcgtcgaattcatttttgtatatcacacagaaggagaacatagtcgtgggcaagagtagatatttgaggttgaatagatggaccatttcaaagcttatcttttcagcctgacctttaaggctttgctctggccgttccctctaaatcagtgattgaagtttgctcccagatcctcatgagtagctatcaaactctccataagccatgtaggctcaggttcttggattccaggtattacacttcgggcatcatagtctgaatcaaaattgctacttttagctgcttagtagactgccattaccaatagtttaatgagaactacttttttaggggacggggggaagtgtggtccacagatccctgatagcccttcgtgtactatgtagtgaatctgcttgacatctagaaaagggaagagtaatatagaaaaagaattttgttgacctgcctgcatttaacaaatgtaaaatgtaaaattacagctttcacaggaatctaatatgcttttaataatcatatggattggtaatccatttactcctaatccctaattcgttttctgcaatgaaatgttgtcaaagggtggcatgaagctgttagaatttaagcatgattttcaaacatagcacattttttttgtggttttgtttttttggttttttttttttttttttttcagaataatttcaaaaatagtgccatatgaaatagttttgttactgttggcaggaaagtccaaaatgttatctcataataaaaacaggtacaagttcagtcttggataaaaacttttgaagtctgccacaaacaaatactatacaaaattttttcatcaaatgtcaagactgtggtatcaagactttataatgatatcaactgtagtggtgacagcttagtttccaatactttaactctttttccagcacttcatatttctttttggtttgagatgaagtctcgctctgtcacccagctggagtgcagtggcgccatctcagctcactgcaacctctgcctcccgggttcaagcgattctcctgcctcagcctcctgagtagctgtggttacaggcacacaccaccacgcccagctattttttgtatttttcatagagatggggtttcaccatgttgaccaggctggtcttgaactcctgacctcaggtgatccacccacctcggcctcccaaagtgctgggattgaagacatgagccactgcacccagccttcatatttcttattccttaggaaaaaaactaagatgtatactttgggttatatttaaagtcacattcaaatcccacaacaggatataaagaaatacttttcagggccaaatacaactggagaggattagaaataaatttacctttttttctctcacgttgaaacatctagccctcccatgtttgagtgtgaaatggctgtcaatccaatgtgatggagtgctgaaagccgtcttcagtgagaagtctctccataatgctccctaacatcagatccatgttaatcctgatgcacagaactgggaataggtaatatagcatagtgtttaagagcacagatgctgaagttagactgcttaggctggaatttagttaaccatttgtgtgactcagtttcctcatctgtgaaataggcataataacagtacctgcatatagactgttgtgaatatgaaatgagttaatatatctaaagcccctagaaaaagtctgacatatgtgaagcactacatttgctataccttatctatcaaagcctacagcttctggctaacattcccagtgttctataattattagatagaattttttttaacttagtagaaacaaagactaagaagggaaactagatgtggacgtgacgtctagctcaagattcccatgatggagccacatagagatatggatggcaaccagcataatgcctctcactgacataactatttgtctgaatttatattttattgttattatttaaagcttactgcaaattttaaaaactgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggtaagcagttagaatgaggaagcactatggctcagtaggagaaagaaccttttagccatcaaagcgatctagaaattaaaggactgccttgggatctgcctgtcactgagagctggctgcagaggttttacaatcagggcttttgtaaaaggaactaaaatttgagtttggacccaattatcttacattctaactggatgtgtagaatctccaagaagaaagactcttctgtactgttttatagattttgccttccactccaaacatcctgagtcatgttccttttatacttgcatgtgagatgagagtcagagcactgacctcaaagccagcgaccgggttctactgttcctttctgcaagaacttagactatgagactcaatcccctcaaccgattaatgtaaaatcccctccatgccaatcttgcagaggataggggtggctgtactggtgatcttgctggggtaatggggtaatagtactggggtaatgacggcaggagtggtggttctattgctgctgacgttatgaacctgctttctcctccactttggctttagcaggactgaagtactccttggtgtgttcttatcaaacccttttttttccaggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattgtaagttccagatttgttcctcaagcactttgcaaagatgtcttctgtggctgaatgccagtcactctagatagaatatagccatcagatctttgcttcttcctagacttcaaaatgtgtgtgtggggtgtgtgtgtgtgtgtgtgtgtgtgtgcgtgcgcgcatgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttacatgtgcagtgaaattcactgggctttaggaaattattataacctttcagacatactcctcgcatttttacatgtttgcttgcttttctgagtgcgtaacaaaactggagaaggtctaatctgattaaataataggtttctacagtgtgtgggctcaagtttctatctccattccaggcatagtatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactatgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgttcatatagttttgcattgttagtattcatttttagatttttatctgtttagttttacatttagattacacacttcattttaaaaccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagcacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatataagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagttttagaaaaagaattgctgttttattcctagcattaccaaggagtctgggcctagggacagagtgcatcagaaattctcagcaaaagtctatttatgaagtggcagccaaggatcctcccccaaaccagtgcttttattcccagtggatggactccaggtcctaactctctgacagcagaaggtggtacagacatttttactagagttgaaatccaaatgactaaagggcctctggaaataggaggccaactccacaggaggctaaacactttaaggtacctgaaacttggcgcattagtgaccaacacactagcagccttttgctcccttatgtcatcaaatggctacagttaaaacattctaacttgtcagcctacattaagaggtagttttgtacctctgcaggaaagctgttcttttatatactcaattcttcttaataaaatgttttaaaagcacttatggccagtgctttatgtggatgttggaaaaggaagcaagagtttggactaaacctgaaaaatccacatgaactttcttcctttttttctaattgcctacgtctgctctctcacctccaaggagtgtttgtctgtgcctcttgtctctctttctgtctcacacaacacacacacacacacacacacacacacacacacacacacactttcttcttgctgttacatcatcatttcaccagaactctcctaggaaggagaaaaatggttcaagaaagagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacacccagcccatgttaaattttctacgtgaagatcctaaaagcccccaactactcagatttaaaatcaggtataattatagccttttcccagaaaattttaattgataaccacctgactcatgctttccagtatcacagaacctgaaatgctaaacttctactgatgaaaaaccataagcccttgtattttcttgagcatttgaggccttaaaaagcaaaaaaaaaaggttaaaaatatttataacaactgacattgacattaacatttgctcagtgctttaacttttatgaagcacttttcttttatcatattaccctctaattaatgatcctagaaaatagttacagttatttttgccttcatttccagtggcaagaaactgaatcttagaaagtgtcagcttgcttagttccatagagtatgagtgtcagagctaatacttgaccctgggcctctgattcccaaggccggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttgtcatgcacttcttttctgttatgtttacctgtgggtatggaaggatgtatacaaatgtaaccacacatctgtatacatgtggttacatacacacacacacaatgagatcataccttaactattggttagtaccttgcttttgttacataacagtatatcaaactttgccttctatacagtccgttttaaatattcttgaaccactgaaaaagaatatatgtcacctacatatgctttctgaaggttgattcaaggatattttccaaaaggcaaataaagtaatcaaaataatatgcacaagagatgcatagcaaataaaatggtgaaaagcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaaccttaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatagcaatgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagagcctagcaaaaaacgagatgcttaccaaatcattttataaagctagcgtgctcccaataataatacctaacctaggttacccccagaagacaattctgtgataatctaactttcataaatgcagaaatcctaagtgaaatattagcaaattgaataccacataataaaacattccagttattccatattcagtgctagaacaattaggaatcttttagcataatttgctatattgatatatcaaaattttagaaaaactagtaatctccatagatgcttttcattaaaagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcactttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgccctagtttgtttaagtcaagcatgaactcaccactcaatgtttgccagagtttggatgaatgtcagcatcaggctactgtaataatggtttaagattatttaatcccattagttatacacttcattaggctgagtgaattgttggcagtggttcagtaaacttcctcctttagagataaaaggacagaaagaaaataggaaaggagcctattcctcattttctttcatagttataattcttttttttttttttttttttttttttccgagacggggtcttgctctgtcacccaggctggagtgcagtggtgcaatctcggctcaccgcaagctccacctgccgggttcacgccattctcctgcctcagcctcccgagtagttgggactacaagcacccgccaccacgcccagctatttttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatattagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttacttttagcttcagtttcctcacacttagaatgaaaacaaacaataagagcaaaccagtttgttatatgttctcacatctgactttgtaaaacagtttgaaaacattagcgtgctcagctccaggattgtcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaaaagaaagaaagaaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttccgatctccagccttaaaatgctttcctggaacttaaccaactagatgtaaccatttctgaacatgcaaggttttcatttccacatctctcataggattgatcctcaccacaactggtattatcaagtcactggcatccttgacacactccagtactgacaggaaccccttgaagactgtgcggggtgcggggaggtcacccttttttcttttcttttcttttcttttttttgagacagagtctcactctgtagcccaggctggagtgcagtggcgccatcttggctcactgcaacctctgcctcctgggttcgcgccattctcctgcctcggcctcccgagtagctgggactacaggtgcccgccaccaagcccagctaatttttgtatttttagtagagacggggtttcaccgtgttagccaggatgatctcgatctcctgactgcagggaggtcacctttaattcgtctttgtcttttctgtagtgcttatcataataggtgaacctattgctgctctgatagtgagggggatttggggggagcctgtgtcactctagcactatgtctccccacagtcattgactcacataccctttgcttgccccttcgtgcacctaggacctgagactatgtatgtataagaaggaaggaggagaacttggctctgagagactatgaacagagtcattgctgaaatgtaaatatcaaagattgaagggaaagatgtgagagtgaagccagctgtctagcttccagccgtagaatgatcataagagctactacactcaaggtcaaacacactgactcacccatgaaaattgccaaggagtttgagtggaagttctctgatattccaatgactttgaatgggacacggtaattccttcccacagccagggcttacttaaaataagtaaatgaataaataaagtctactccctggatcttttttttgctcttgtccctgcagagtaaggggatgccagccaaggctgacatcatcattatagcaagacaggtgctttttttgaatacttcacaaggacaagggcctggtattatgtaggtcttcaaagaatatatatatatataaatttttttaattcagtctcctacatttatagtatggggaaataagacaagagcgaggaatgccttgcttgggatattgcaattggatggctgcactgaggactatttaagcaaccttaaaatcacaaacacacatctgtgatgactttttaattatatctgtcattttggaaaagatattaaacatcttcctcagaagttatttttactttacacactctttaataatgttaaaagatatttgatgcaatttatattaataaagctcatgggacgtgttagtaaaaataaaattgaatcttctaaaatatattcctttaaaaatgaatgtctataattttatgctagtttaagcaaataatctgaataaatcctgtttgtttagcataacacatgtacacgtagtttctccacaaaatggaacgcgctaaatgtgttggggcctcaggaaagaactagtggaagggggcataggaggatttgggggcaaaaggaggaatccaaaaagaaggtcttcatggaggaagagacctgtcccaatgtgtcattcggtagatctcactttctcctagtacctcatagtcattcatttttcacccccaacagacaagtggagactgatattattcccttttacaatgtaacaaaatcaaagcttagaaaaccagggggtttggaaaataaggaatttgtgtaggattaaaatagaactttgagctcctggactctgaatcttagcttctaccttgcacttaaataaatttatgctaacagatgtcctgtcatcagataggacttttttttttctttttaatgtcggcaagtctcattgttacagctctctggtctgcccagtttggttacacctgttttgagattccttgcctatacccttccaactgaagacaagcacttcctactgtacttacagaactttcatctatgtcttggtttaatcttttgcctttgttttaaccgtttaccacttctgctttatattggtaggtaatcttacccccaaatacatagactatgagctccttaggagcaaactcattttttttttcctgttgttctttgtgtctttttttccctatccacctccaaatcttactccacatttctgaaaatagcacccaaagcaatacctctcactttggggagtatttagtacattttttaaaaaatgaatgtattatacagtctggatcaccataacaaaaatacaaggactgagtgccttaaataacagagatttattttcttatagattgagaatggaagtccgagatcagggtgttagcactgtaggattctgctgaggactgtcttcctgacttgtagatagccaccctctcactgtgtccttacatggtgtgtgtggggagggagcaagcccactaagtgtcttttcttataaggtcactagtaccatcatgagggctccatccttatgacctcatctaggcttaatcacttctcaaaggccccatatacacatactatcactttggggttaaggcttcaacatataaatttataaagggactcaatttagtccatagcaataaattaggccttttgactatagatctgtaagtgcataattggcactgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgatccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggcacaagtggcaggaagccaaactgacctgagtctggctgggcagtgtctgcaggttactccagcaaagctgctggaataacgatgtgttcttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaataacgactcccaattccctgagttaccattagatggtattaagcaacttcacttaattatgtacctgttttccagttatgttaattatacatcctttagcatttaccacctgtaccaatcatttagcataataataccttatacttaaatgcaagtacccagaatacttttatagttgttttcatttgatattcacaacaatcctacaaggcaagtgttatttctagattagatatgagagaactgaggcatagagaaggtaacccatatagccaagaaactaaaacagggttctgacatccattttctaactatgcatctaggtttttttttttttttacctctgcgtctaagttgcctgcctaaatcgccttcagtccattgaaatccatccaatcaatatttactgaacatcatctgtatttcaaatattgtagtgggcattgggggtatgaaattgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttgatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaaaaaaaagatgtccttgaaaaactaaggaatgttagtgcacttatagaaattcttgcagtttggagtaatttgccacctccccttctgaaaaagtacctgatgatagtgtgcttgagagataggggtattgcagacatattccttaggtgagtaaaactgaattgtaaagtggatgctatggaccatggattatttcatttagtacgattgacagtagaaaatcaggaagggacgtgcatcagtgcgaggctgacacacagatctgaggatggcagaagctcactgaatagcacacgcaaggacccttcaaactcatcacatgtgccgtttggttccctttcaatgggtcggtcttggaatatggaggtctgctttcattttgtgccaagtaaccacgtgagcagtttacaaaagatacaaacagaaggctgctcattcatttttcaaaaagacttttttttttttgcaatggagtttgcaaagtgattttgcaatggattttgcaaaaaaaatggatgccattttttttaaataagtgtaattccaatgatgggaaatttactagctctcaaggcagcttttccttgtgttgaaatctctaaaggttaaaaagttactttttggaaagaagtctatttccttacaacatgttttcattggtccatagagaagacagctaatacatcttccacttggcagccttttaagtatttgaagaaaattctcaagtccatctgaatcttctgttttggctaacttctagttccttcatccatttccaacctaaatttgagcctaacgaacagatttcttctttcttatttaaatatatatatatatgaggaaataaaggcacagagggcttaagggagttgcccaagaacatagagctggttggatgactggaatgtaaggctgtgtggctctaaaccttgtcatttagactagaacacctatacgtcagttagcttcctgccacttcttgttttctgcctggataggactttataaagagtttggaagaagggagagttccgacgaggtacagaaatcagaacttccccttcttccaaactatatacaaataatcagttaatcagattaaaggactcttagtaacattgaaatcaaacctttgtgtttccaggagctctgagaacaacaatttttttggagcattgcaatctcttgagtatccaaaatgattctgtaatgatgtctgtgaggtcagaattggagcagcaaatggaattcctttaagggcttcccatcaatggacagctgattccagaaatggaggaggcacagtttgtatccaaattcataagcacaagtgggagaaattaggctttggtaaagagggtgacattcccaaaggaatcatctgtgaagttggggaaggaattcaagctcagggctgctgttctctaccaggttcttcagccagctggacatgctccccaggtttctactcagtctggaatgttagtaaaagtccacttcctctccttgtttctcccttctagtgaaaacgttcctcttctctaccttcctgacctcaagaccattgttccacacatcccccctcaggatcccaccccgccattctcattctcattacattgtttctggatccatgtctttatcagatgcagcccactgtccctttcagaagatgccagaaaatttacatatgtgatcaaatgttcccatcacaacagttctttccagtaatcccagtgctgggcagctgattccagtaatggaggagacactttcagctattaggcaatggatcacactttcaaaggagattgagcaatctcctcatcaagttgtacttagagcacaaatctggtgccaaaaggcactaccggattcagactgacagcactgagagttttgagtgaaagggaagttagactggtgttatgtgtattcactgggaggaactcaccgggagaaataaagagggtttccagtttattcattgtgtaaagcggctataatagtatttataggggttttgtgaatgtcaaataaaattatatttggaacagtggctagtgccataagtaggacttaacctttagcaatatgtactacattaaaaggaaggtggacacatgagtgatctctagcattttgtgactggaaggaaagagactggatgaccactcttcagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaaaaaaaaaaaaaaaaatctatcaccccccttgattcacttacctcccactgtgtcccttctacttcacgtggggattatgggaactacaattcaagatgagatttgggtggggacacagccaaaccatatcacacatgaaacacagaaaaaggacatctttttacatggatcttctgatatgcttgtaccaaagcccacagtatatcctgtcttcttgaaagagtatcatagttattcatttgccttggatggaaataatgttgtaataccagttaatacttttttcaactaaagggaatttggcttcatctccagttgcaaattcacatcaggaaatatcaaatccaaagatcaaaactcagtatctcatcactttcaggaccatccttgccacttgtctcaggcatcatgtacctggaagctgaaaagcaatgtacagaacctttgaattggagagatatcaatttgaacccagatcctgctacttcctacattgtgaaagggatcaagtttctttagttctctaaagcaaaggtttttcatctataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattggtctccatgtatctctggtccctttttcccctgtcttctgagtgccctggctccatggatcatccattctttatcctacccaatgggattcttctcgtcaacatccatttgtgccccagcttggcccatattttccctccattgactccacagctctctgtagctattgctttatcccttccttcacagccaaactctggaaagttggatattagaaatgctgtctccacactattcacaatagcaaagacatggaatcaacttaaatgcccatcagcgacagactggataaagaaaatgtggtacatataccccacagaatactaagcagccataaaaaagaatgagatcatgtattttgcaggaacatggatggagctagaggccattatccttagcaaagtaatgcaggaatagaaaaactaatgctgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctgctaccaggcccctatcccttcatagactagctgaggacatcagggacttccatgttgccaaaaccgtgagtctaatcagtgtttacctaacttgatatctcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaatcttttatccctcgtcccccttccacgcttccccccaaatccccaaagtccgtcgtatcattcttatgcttttgcgtcctcgtggcttagctcccacatatcagtgagaaaatatgatatttggttttccattcctgagttacttcacttagaataataatttccaatttcatccaggtcactgtgaatgccattatttcattcatttttatggctgaatagtattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatattccatcatatatatatattccatcatatatatatattccatcatatatatatattccatcatatatatatattccatcatatatatattccatcatatatatatattccatcatatatatatattccatcatatatatatatttccatcatatatatattccatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctcaaaaaaaaaaaaaaaaaaaaaaaaaaaaaccaaccatcagtgcagaagaggatgtggagtggagagactgcatcaattatattttgctgatgagaatataagatggaacaaccattctagagaaagttttgggaatttcttcttttaaaactaatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgttgggggaaactggataaagggtacttagatctctacgttatttctttcaacttcatatgaatctacaattataagaaaatttaaagtttaatttatagaaaaggcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagcatttaaagatgttgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaaggtgttcccttttaaacctgctcctctctgtgttccttttccatgaatggcattaccttgttgctccaaccaaaggcacaggagctggcctgtatccttcctcttccttcagtatcccctcttatccacttattaaccaatttctgacataatactttggcttcctttatatcttctttcatttatgagacaagttccttcagtgttttctagtgacttttcattacttggaagagacagttcatactcctcacactaccatgtaaagagctcatagccacatgcacacacatgcacatccacttgtgcacacatacctaaacacacacccaaaacagagagattgtctcatgcctgtggctgggtaaacacttgtccttgatggaatgtgtagctttcccatctccatcccaatcacctagccaaaaactctcctccttcaggcctccatttagacatcacttttccctcaagtatgtgtgattcttgtgccttatcctccccatcatcctgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgagtaagtgtttcttgactctggggctgtactgagttgaagaaggatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccatccttcaggtctcagctgatttttcacttcttccatggagccccctctgacttcacaagattgcgttgtcctgctcatatgtcctgctcagagcatgctgcatgtctcacttcatagcacctgttatttttttagtatagattttggttttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacaacttaacgcccttcaagattttgtgtaacagggaaaggagagaacacctggaatggttcccgcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgcagtgcagttcagtgcaaaccaacggaaagcccacagtttttttgtttttttggttttttttctaggtgtaaacaaacctggttgattgtgaggcaaagaaaaataacaaaaacaagtgagaatacattagattaatttactctttcttttttcccgctcattcataatgtgattgaaatcagaagtaaagaaagtaaaatcagagtgagttccctctgctcagtcacccaccctgatcacaagacttttggaatactgggaggcactgcatttaagtaagtatcagctgtatggagagtatgaggttaagatgatgctggatttaatttaaagtctcctcactggtttgcgtgaaggaagatttttatcaagcagagtgaaagagacagaatcttgaagcttccgcagaggggaagaagacagggccgtgcactgcgagtcagtatgcctccagtccctctggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatccttttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgctagggccagtattgtaggtggcaaccaggtacattagtctctgcccttgtggaactcatattcccatgtttgtaaaggagtctgggcctcttatatgtggtaaatgaagtgactgtctatgtagttgcctttgcaggacacaagtccttgccttagtttccctccagccaggactgccccaccgagactattcatagctccaacttaaggtgctttaataaagggcagaaatcatgacaagaaaggacgcttttcttcaggcaatgaattcagcctgattttagaagctgttttggagaggtctctgtaagcatattacattttattccctgcagtacaatatttatacatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactactctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaaaacagtgttccttctacaaatattctattggctggggctcattcactttcacacagtaacaaagaatgcttggaaatgtggccacactgtatacccccaaaagaagaggaattagtttggttcaaatttatctagtctctgtcatgctttcatcatcatcatcatcatcgtcatcatcatcgtcatcagctactgtggatcagcatactttcctgcaattttccaaatcgaattttgtggttatatattaacagagtatataaaattcattttccctacataatatgtattttattcctatatgtgttttctgcagtggtctgatttatatcaatgactaacatatagattcgatttgcaccaactagataatttaatctcttactcctccttgttgacagttggtggggtgcgccttatttttgaagaagaaaatgcttatccagttattcagccaatctcagttgacagcctatcacatgtcaggcactggaaattccgtggtgagcaaaaacagacaagtggcctgctttcaggaagtttctattctgttaagggagatggacagagtgttttaaaagaaaggagtattgtcctaagataattaaaacacaggaacctgacttagacagagattaagacaggcattcctaaggaagtgatacttcactgagttatgaggagtgagtaggagtttagacatctccagacagtgcagcacgctgatttgaggaactgaaagaaggccagtgtggtcagagctcagagactgagggagaagcatgatgcaggatgagttttgagagataaaccatgaaggacttaggccttgctaagcattttggcctttttcccaaaagtacaggaaagcctagccattttattattttataccacccatccattacaggcttttcctgaaaggtctttggcaataggggagctatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattggatttgaaccatatttcttctgctagccaattccatcttatctacaactttttgataattattttgagaaatagatctagatcacagccttccaattcctaggccaggatactttccatttttctacacagaccccattgcagtcctcccttcttcacaatcttcaaaatatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccctcctcctcctcctcctcctcctcttcctcttcctccttcttgcaaatacaaacacagcagggctctatgcagctggttactctaggctctggtaacctaacatagcaggggaggacagaagtcaatagcgtgagaagtctgtttttgtcacggatttgctagaagctattaaagtgttcttcctaagtctgttacttcataggttgagggaagtaatgcatcccacacaagaggactgggatatgtttaaagtagtaggaaggcatttgccactattctagtccatcctgcccatgctgcctaatgtttgttcctacagatcaaaatctcataatcttctagacttctagatacagaagagttggagagatcaaagccttgcctctgacccagattattcgatctcatctggcatatcctacactctagccatcctgacctgccgtgtgttcccctaaagctcccatccttttctgactttgcttttcctcattctgtcccctgcattgaaatgcctttcccacatctctatgtctaaatcttacatggccaattccaacgtaatctaatctctgaagattccctttgctccccagttagaagtagtcactccctgctctgctcactttttgacatatattaatttatatagctatgcatttatatgtgtatgtattatattccttacaagagaagcttttgagagaagggcctataacttttctttctatttgtgtttcccaaagctccttctggtgggaaaaatgctttgaggttgaattaagctcacattgaactctatgatgaaaccatttgcttatgaacttggacaagtttctttacaactctgaaccttctgaattttccaccaggagaatgggaatgaataagtaagaaaacttataagacagctcctggtgtagggcctgactcatgtcaggttcccaggaaggccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacataatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatagtgtagtttctgatgtcaaggaacactttagagagaccttaattaatgtagccatatgttgacttcctggagcactcataacaacatgggaagcccacgctgggaagatgctgagtaggaataagagaacaatgctaagagaagggaaatttcaccgtctgtgaagcgtctgtttagattttatgtttaaactttatgaactctgtcacttgctggtgaattttcttgctcagtatcttaaaatacagctgcagtgtgggttccaccctcttcacttaaaagggtgattaactgtttgtgatgaataattatttaattgccagttcagctacatgtgtgtagttgttttgcttctttcctcttcagtgtgagccaaatcttctcaataataaaaataatccagaattagtcaactgccttttatcatgttctcattcagcctgctggagcaagaacattccaattctacatcacctttagcttaaaaagtaaataaatagaagctctcactcagccagttgatagttttactctcacagcctctcctgtaactaataaagtcttgacttcatcttgaaccttttactctatctttggataaaaatttaatcagaaagaattattgctcttttaatacctgtttaacctttacattcgcgatgggtacaaaaccacttaagatttaaagctctcttgttatggacttgtatgctgacctacttttcctcagagatattttttgcaagaattgttgaagcttgacatggggatcactgcaaatgtctcagctttgccattcactgctttccattcctatgtcctccttgccctgttaattattttaacagagacttgctattttaaggaagctctttatcgttactaaatctttttttattgttaaactcctttttctttccagcatagaagtatgtcatgttttctgtcttcagaatgtgcaagtgcttaccttctcataaagtgtgcctgttaccttaattttatagtctttatcacaaaaaggtacgtaagtggggttcagaatagtgtcttgcacttaaggtttaacttaggttttagtttcttcatgcaagcaacttgcatatgtagagaggcagcatgctatatagtgcaatgttcttcttggtttttaattataaaagtgatttcttttctagtaaaaaatcaagttatgcacaaatatatagagtgaaagtgttttcaactcctctctctagaggaagccactagcagttggcatatttccttccagaatttgttgtgtattataaacctatatacgtgcgtatgtatacacacacagtagtacacacattgttctgcaccttgcttctttgttttccctaagaatgtatgcttgatatatttctaaaaataataatgtatatgggtctaagtatttttagtgatatagaattctataggatacatgaaccgtaactcccttagtcatttctctactgattagtatttaacattgtttcttttttttttttttttgccattaaaagcaaatatctttgtgcaattatcttcatgaaatgttgaagctttctttttttttttttttttgagatggagtctcgctctgtcgctcaggctggggtgcagtggcgcgatctcagctcactgcaagctccacctcccaggttcacgccattctcctgcctcagcctcccgagtagctgggactacaggtgtctgccaccacgcccggctaattttttgtatttttagtagaggtggggtttcatcgtgttagccaggatggtctccatctcctgacctcgtgatccgcccaccttggcctcccaaagtgctgggattacaggcgtgagccaccacacccggccaaaactttctgcaggatatatttttaaaatgggttttccaagtcaaaagtgtatgtatgtttccattttgatacctactgaaatagctctccaaaagtgaaaccaaatttattcttttcaatggtatgtaagaatgcctgattccccatactctcattaaccttgagcatgttccatcttttaaatttttgccaagaagattgtctaaaaatggaatctcattgtttgtatttgcatttttatgatttttggtggatttagcatcattttctatgcttagtaactgcttgcctattcatatcctttatccaggttttttgttttgttttgtttctttttggtttggttattcatgttttccttattagtgtattggtagttatatgagttttaaccctttgtcagtggctaatttggaactcctccacagatccctgggggtttcttagagcagctgactggctggcagagctctccatggccttacctccccttcctcttctccgaactcacacacacactgatcgaacagaatagaccaattattacctgcatttcatgttgggctttgtgcttgagattaaacaaaggttcccggggctaaacgtctaaaaaacattgccatggaatgaagagccctagattttgtcataaagtcatctgtcctaggctctacaatgtagcattttcaaattggaagagccttcagagattattttattaccaacacccatgtaatataaattatacagttaatatatgttgatatacatgcaatactgaagaaatctctaatgcattctatattctgtaacagtaatatgtattttattatttataatagcttcaacatatattgaaaactagaggcacatacgtctataaacagtgctcagggcgtattattttggtgtttatttatttattaggtatttattattttatttagtccatagatgatgcatttatctgagaactcctctgactcaaggcccagcaagaatctgctgcccacagttatgagtagctgaactgggccaagcttttaattctataaatagcgaatctatgtagacactcagctagttagtaccagagtggtacccagatccgtgatgtcttgactcttagtacagtgcacttttccccactttgccattctttgctggtgaccttgggtagatcttcttaactgctcagagcttcagttcttctctcttttaatgagagtaataatgcatgcattgatatcctgactaggatggagttggataaagactgttcttaccttttgtgaatagcatagtatcttacagaattgtgaggaattatccaagtagctattgcccctcatcatggtgttaaaagtaggattgctagtttgaacggtaactgcaggaattcaatgtgttttgattttagcatattcccgtatcatgtagaccagtgttaatatttttagtattttatcttagttcttttttttctgaaagtcttgatttttcccagttttattttttagatttgaaagaaaaagaaaaaggatgtaactatgactcttatgttttcaatctctctgaaatataacaaagtaataactctaaatggtcaacgtagtagtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccaacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttagattgttaatttctttaattattgttttatatttttcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatggaaacatatggacatacagaatgaaataaaggtgggaggatgatgagggttgaaaaaatacctattggatacagtccagtactcactcttcggtttatgggtgcactaaaagcccaaatttcaccactacacaatatatgcatgtgagaaatctgcacttgtacccccaaatatataaacattttaaaagatttaaattacattttctgtgagtagaaacagtttcatttcattatttgaagtcatgccttttctgtttcttgcccaattgccctggctagggactttcagttagttgttgaatggaagtggtgaacatgaacatttttgcgctgttcccaatattaagagaaaacattgagtcttttgccattaagtgtaatgttagaagtaaggttattgaacatgctctttattaagctgagcaagtttccttcttttcattagttttctgggaggtttaatcatgaaagtgtgttgaattttgtcaattgcctttagacataagttggtatgataataagacttttgttctacagctggttcatatggtaggtaacactggttaatttttaaatgttgtatcagccttgcattcccaagataaaccccacttggttgtgttgtactactccttttgtgtgttattggatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcattcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaatttggctaacagtattgtacaagttctctctattcttactgattttctgtcttctttttcagtaaattattagagggatactgaaactttgagcataattgtaggtttgtctatttctcctttcacttgtatggtttttgttttaatgtattttgaagccatactgttaagtgcacatacattaggattgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacaatcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattggttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaagatagccaatatctcttcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatatattgtttcttgactttttaataatcgccattctgactgtcatgagatggcatctcattgtgattttgatttgcatttatctaatgatcagtgtcattgagctttttttcatgtttgttgactacataaatgtcttcttttgagaagtgtctgttcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctagggcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaagagtataaattaaattccgcttctatctgcactgcccaaagattctgtgttttaatactaccctacaactagtctcttgcaactggttaataactgtagttttttttttctgttaccaatagtatggcattcagaggccttaaggcagtaaggcatctgccttagtgttctgcaagtgttcacatcctgtctctcctcagaggcatctatctttccttagatttcaggttacagtagtttccccaactcccacttatcagtagttttgccttctgcagtctcagttacccatggtcaaccacagtccaaaaataggtgactacattacaatagtcatgtagagactattgtctctctacaaagagagagaaagagagagagagagagagggagaccacatacatgtaacttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatgggtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcatataatgatttcagtaaattattgatataaaaattttcaatgaagtataactcatagaaaagtgtacctatcttaagtggccataggatatcatttagactgtaacataagagaactatagatattcacatccccaagcattaactgagaacctgttatacagtgggcatttaggaaatgaaaagtgaaggaaaagttactgaccttaggggtcttgaaagcgagaaaatgattaagtgctgtatacacacacacacacacacacacacacacacacacgcacacacgctcaaagagtagggagagaaaaattatgattggggaaatcaataaaagcatattggagaagacatcatttgatattaacctttaagtatagcagtgtagatagtgcgtaagaattggattatagaacttagtcattatgttaggaaagaaacctatggccttgttttatagcaattactggggatatccaggtcttttgcactggaagaaataatcttagaaccatttattaaggacagacccttacagatcatggggtccaaaactgtcttggggtcgaaaactttctcatcttatagatgaggaaactgaggcttagggaagggaagggacttgcctggggtaaatttttgctagtaaatgtacttaatgagatctctcagttacactgaaacgtttgagtattggaacattgtgcttttgttgttttctttttctttaaatccttaaaaaagttgtggatacatagtagatgtatatatttatggggtacataagatgttttgatatagacatgcaatgcataataatcacatcacggagaatggggtatccatctcccttcaagcatttgtcctttgtgttgcagatcattagaatattgtcttcatcattcttttattccccaccaaagtttttgtaaggtagtaagaggatctttgtggaaagaattcttattcccttacgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctccagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattcctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatagcttctgtatttccactcactcagtatgaagtttgctattattttccccaattcctggagccagttattgcagcaaatttagcatttggagcttatagactcatgctagacagacacatatagaatttacgaatcgaattagaaaaatggtctttgaataatataaattgtactccatgtatatttttatatatgaatgaacctactggactccagtgagattagcaaataccttagctatttcattgcaataaaaaccatttttcagtcactcatgtccctctgggttcttcagtgatattatttgatgtatgctttattctgtgccatttattgtactgagtattttgcatgaatgatcttatgtaatcatcagtaatctgttaaatcagtatcattattattcttgtttcattgatattgaaatataaaagtaggttatcataaattaaaaggctacgggtagtgataaaattttattccaggtagtatctccagaatatgaattcttaatcactactcgtgtttattcattccacatgtcactgaatgcctactatgtctagcaaagttctagattctcttgtagttgcattactcagttattggctagataaccctaaacactgcagaaagctgcactctgcccccttgggattgcctggctccataagattattaccgttgctgagtttggggacccacttgagcaaatctagcatacttaaaaggaagtttttattctggagaagttttgttaacaaaacatctattggctgggcagagtggctcataactgtaatctcagcacttcgggatgccaaagtgggcaaatcacctgaggtcagaagtttgagaccagcctggccaacatggtgaaaccctgtctctactaaaaacacaaaaaaattaggtaggtatggtggtgcacgcctgtaatcccagctattcaggaggctgaggcaggacaatcacttgaaccggggagacagaggttgcagtgagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataagcctgggcttaagattgtatctctgagtgagacaaaataatagatgattctatctccctttagaaaaaaaagaaaaaaaaaaagcagcagcagcagtaattgactcttacgcttaggcaagaactccacaatggatttgttggggaaaaaaaaaatgttttcctgcttgtatgtgttggtttagattttctgttgtatgtgtgttgtgaaagaagactttggataattattgcgattttccaagcagctggtcttccaatggcattgttacagggtcagtctattttcctttaatctgaccataatgtcatagaacactggctgtttctttggcaactgttcagggaagactagctgttttctctacctcaagccaatggtggactgcaggcaggttctcctgcaagccacagggaagcagttttcattactggggtctttgtatcaacaaatcacttatttcactgtgattctgttgagacaggatccgaaagtaaatttcataagaaaaaaatgattatacatcaagctcaggtgactttaaaatttttcctttacattgagtaaagtttctggccacttttgaccttttttttcaaatgacattattgatatgaaatcagaaactataactgataaactacaaactgctgtatagacacttttctacacaatggtcattgcttttattctttatctaagcctgaattgtaaggcttccttctctttttttttttttttttttttgagatggagtctcgctctgtcgcccaggctggagtgcggtggcacgatcttggctcactccaagctccacctcccgggttcacaccattctcatgcctcagcctcccgagtagctgggactacaggcgcccaccaccatgcccggctaattttttatatttttagtagagacggagtttcaccatgttagccaggatggtcttgatctcctgacctggtgatccacctgccttggcctcccaaagtgctgggattacaggcgtgagccaccatgcccggcctgaatgattccttctcatcttctgggaggtttttctgacttgctttctcaattccactctcttaggcagagcttatacctcccttcatgtatgttacatgtacatgtattgagtcagtgcatcctcctaatgaaacttttcctgagatctctcttatttactttcttccttttctgaaattctctgctatttagattcagtgccaaagaaattgacatttttatttacttgctgaggaataaacagaactcgaaaggatttgggaacccaagaccaagttttatgaaataactaatcttgtcttcctaaatactataaaaatcttatataatccctaatacttagcatagtgctaagcaccgaataggaatacaagaaatattgcaatgatctgaattgcttacaaaatattgacaacaacttcttcattggtaaagaaaagctgcttttgacctttttttcttcctcaagagtaagtagtgagaagcataaagtacccaagagtttctttgcctttttgattgttgcatggaaacaagtatttgcaaataattaagatgggaaaatttggctccttgaaaaggcaggactgctttcagatatatttgaaatgaacttatacagaagccaacatggttatcagagcaattgggtctatttcctatcatctcttcatgatatcttgtaaaaatgccctgtgttgagagcactggtgatcatagcagtggggttggagtagaatctggtgcgtttcttcctctacagatctcctaatagcacttgccctgttttcacagagccttatcaaagtttgatgtagactccagtgtgtagtagtgggcagtgacctaccagatgacctctttgaacaagagctagtttgagccagtgtatagctctgaatcgatggaagatccattttcaaatttcaaaagggctgttaaaacacttagttctgtattatagagatacacaaatggatataacaaactggatgtctcttctgcagctgtttcaattcgtatgccatgttttctatccttcttgctcctggcaattttctttcctgaagcatatcacaccttcttacatttgacaagcattttcacagctactgccactccctgctgccaaacaaaacccagccctgtttgaattcttgagggctgagggatggagaggagacctgtttgactttgaaatggttttaacgtcactttgtatacagaacaaaaatggaaaaccagatcctgtgtttgtctaaaaactaaaatttcaaaacctaacctgaggtggagaaacagatactacagggcaaggaaatgtctgggctcaccgcaaaggaatgcagcaagggaaccacctgcagacacctgtttaagagtttacgtttttgttcttccacacgattattatcttagtatctcaactggctatacatgcttttaggaaagttgcagggatcatattctaaggcgtatcaaatatgttcagagtgcaagcatgagcagaatctctcctctctgctagtgaggtcctgtaggtctacaagttactaacttcaggcttacagaatgttagaagtaacgggtgcatatcctgtaatcaatcccggtattgagcaaacaggcacaaatgacacccagcaagaaaaatgacttgctcaagacaccacagcaagttcatggttttctgaactgaattccaagtttcataacttctaattaatcctcctttttttcccccagtacagctaatatgctttttgtgaataataacatataataggtgtaatctgtcagaactatttaatagttgatagtatgtatcctcagtttattgaggttcaagctcttctgagtattataatactttctattggtattttctctcttgagctattccctaccttgaatctttcagactagagatttcagaagattacgtagtgtctgtgacttcaactacacatggatagtccacaggactctggactttcacggttccatgtcagttggacaggtgttactctaaggccctgcaaaaatataaagtagtttgagaatcactctcctgttaatcttcagtaaaattctgagctatttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctatatgtcaagccactaactgccagccatcagtttgaaaaccgaagcaattaagatcgctgtccatcttacctgaaagggaagctttgcactctaacttgaagtagcctagaaatttcagaaggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgtgtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattaacttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatttcctcttagaattcattctaaacttctttaacagaaattatctttttttgattcatattctcccttttgtcctggttaccagacagcacaagtgaccatcatgtttagatttctgatacagttctctcttccattcctctctgtagcctctgatttttttttcagacttcagttggaaaaatcctaatgaatgtaacttttagttacaggttgaattcttttgaatgtgtatatttaaaataagtaatgcacatagttaaaaagaaacatgtttttaaaacagtggttctcaattatagctaaatatttagaattatctggatggttttaaaactctgatacccaggcagcatcctagatcactcaaatcagaatatctgggtttggtcacggacatcagtattttttttttaaagctgcccaatgtcattccaatgttaagattcattgttttagatattctttattatgatgttcatcatttttacagaaacacatttccaaaaggataaatttcaaaatcacctgtaaacccataatttattataagtcactcttaacacctaaaaatagctaacctgctaacctttttcttttgctttttccttcttcttttaaactaaaattacaataatatatgtgcatatatagtgaatgtattcatttatatattagacacaatttacatatttatgcttatatatatatggcatacatgtacacgttacaatatgtgtatttgttttattccaaatctgttttattctcagagacattttcccatatcttcccagatatattttctgagaacctggtttttaatgcttgtataacattaatacttgtagttagaccattttttttactcattcttctattcttacatattaatgttgcagacaacatccttaaacaacttttgtgtgactaatccaatttttttccttgggaataaattatgatctattgatttatttctatgtgggctgaattttgtccataagaatgaaaatggtagccccctaagatgctgtttgctccctgatatctcatttttctctagaatacgaaggaatggctgttttctgctcttcctaaagattcaggatgtaataatatactgtcacaggtttcagaagcatgggaccttggcaccgaaagggtctctactagctaagttgtcttggaaatgagtgggtccacttcctcttctgatacaggaagaacagggaggtcattaaatgatgacggggctctttgaagtgaaatgaagcaacattggagggtgtagcatgtaaaaactctcttctcggatacaaaaaaaattgagctacttgggctaggagaagtgagcctggatttggaggcttaaggtttcaggaaggtctgagacaaacttaagaagaaatgcatcaagagggttggaagggacagacgattgatgagagcactgaaattccagtgtgatttgggtcacccgtgtgacatggcatatatttatgggatacctggaaaataagggagaaacaagacatctatctctgtcacactttggggaagtatacgattaagttccacactctgtggtggaaagaatgtcctggaggcccccagtctttctcactgtgatgccatgctcatttgataacctcataaacacatttctgttcttattgccttacccattctgatgcactgatcattttttaggccatgtgaacagggcagagcttgtcattatgcctgggacatagtgggcattcagtaggtgtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttataattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgagagagtaatggaatgtgtatgtctctgctcttgaagataccaggggcacctcgaaaactcccctccccagcccagggtcaccacagccttaaccgactgcctcctttgcaaacctttaccatgggtacctagaaaaagacatacacacacacatttcagcttatggtttttgttcgtttgtttttgttttttgtttgtttgtttgttttgccagatacttaagatttaagggcaatcttaagggaaatctcttctcccatcttgactgaggcacagagatgtcctgttcccatgctgttgatgctgacagacgtaggacacgtttttttctccgtgtgccaccacactcaagcagaatgtataagatattttctgtctaccaaggatacctggtgacataatcatacctagcctttctttcctccctccgccccctcagcctctcaccctgccctcccatgggtctttatgtgtgctactctatgtagagtacaactcataccggatagcctgttacttattttggttcaggagcagctgcagaggatgaactggagaggacagtctacttgcaaacacttgtagactctccagtggacaggttacctctaaagaaagagaagcctacgctttcctactcactgaagttttttaccatttgcaagtggatccaatatatgtttgttttgggtgaggggctaacaaaatgctctgcggtttctgcaggtttccttataggagatcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgatgataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggagtttccattctagtggggacacaataaacaaaataattggcaaattatatagaatattggaaggaagtacatgctgggagagaaataagctgggagggaaaagggagtgctgggggagaaggagctaagagtctcagttccagagttaggcagcctgagctggaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctcaaaaaaaaaaaaaaaaaaaaaaaaaactcagctgcatccttcccagtcatgtgacctgggcaggttaagagaactccctgagcctcagttttcttgtctgtttatcaagagtcattagggaaactagtatctccttgggttgttgcagggattcaatgagatgacacatgtaacacaatcattacctcgggcctgtctcctataaatatagtgattgtcacgtttgttatttaaacaatattatatattgtgttttaggtattatgtatgtaatatatagtgtgaatatatgtatgcgttatgtatatagcattatctgacttcgtgcctctagtattacatgcttctcaaaatatctatagttttgtcggtatttctttctcctactagattgtgatcttttatcggcaaagaccacctctcatttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagttgcatgttactaataaggaatcagaagctcagagagggggaatgaaagaatccaagtatatgtggctaaaattggccacgtcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgagtttattggacactgcagaaattcatttacattgtgtgcttaccctggattgttgttgagtccagctgactgttgcttcacaaattaactgtcctttgagacttggaaatattgaaattgcatagagtttttgtgaaatctcaatcctgtagtattgtgtatattacaacaggtgctcaatagacttctggattattaaattgagtaatatttgtagcaaagatctgtaggctgaattataaagctaatctgtggggggatgccaagatttctctatcattctgctatgtttgccatggtctaccaggagatggcgcctggtaagagttccatattttaatgtattctggtccaaatcactggagttggcaaagatggagaaggaggaactgagcagttcatccccaaagacatgatgacaccactataagtgtgaagccagcaagagtgcaaagactgagagcagcgtggtcatacctagacatttatctggagagcaaaatcaagcactggggctcaaagggttcagtcccagcagttaggagagagaggagtctcctaggagtagttgccccaacagctgctagaaagtcctgatcctttttggtctgagccaaccaggtctcagcccagtcccacttgcctcaatttaaagtgacatttttggtctctagctgggtgcttccccctctgtagcatataacaaggatacactttcaaggcagggagcctggaggacaaggagataaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgctataccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgttggggtgtaacttaccatgattacatgttgtgatatacgagtccatctcagcagatagagagactctccttgacagcttgaggaaataagtgaccatatgagagaagctcatgaggcaaggagctgtgagcaacctttaggagctaaggacagcttccagcagacagccaacaaaaagctaggatcctgactcacatacccacaaggaaatgaattccgccaataatctgaatgtgcctggaaaagattcttccacagccaaccctccagatgagaatgctactcagctgacactttgattgcagcctgtaagactccgagtggaggacccagccagagtcatgcctgggccctcagaaactgtgagatagtaaatgtttgttgttttatgccactgagattgttagccaacaatcaaaacctaatacaataataccctttactgttttctagacagctgctatttagaaaagcctcccacccaataaaagagtcccctttatagttttccaagtaggtggttatcagggttctgcttcaccatcttcagtggcaaggaacttccatttcacagggcaaccatgtgtgtattacagaggcttgcatgttgtcaagttcagctgtggtcttcagcgggagcctaggacatgccagggatttcaaggtaggctggtgaggggttcctggttttcttggtcctgaaccatcccagtgccattctaacagttgcaagtctgcctccttcatgacaaaaggactggaggaaaatgtatctggcaagtcgataacactggatcgtttgctcccagctttaccacttggcatcagtgcaaactttcacccagttaaataacttaatgagccctgctctgcatgcttgcttcacagagttgtgacgatcaagtaagacagcatctatgacagtgtttgttggctgtaagtcagcaaatgattgcaaatgatgattattattaaaataatagtcatttgtcagtaaatatttgtcaaagctggtccacactgagggagacaggctctccagggaaactgctgatgcagagataaagaggagaccagccccagtttggaattgcatcactgattctgaattccccatggtacatttcaggtcttgcttcaggaatttgttttttgttttgtttggtaggaacaagaatcccctagagccagttatgttgtcatcaaacttagttgctaattaggcaccaaagcaaacctatgccagtgagacagagttgaaacttgaattcctttctgcaggtggagcgttggatcctagaggcggtgtatacagcttggctattttgatgcttctgcatgcaagaaggtttaagagaatctgagtaaagcaattagcatccctctgtctgcaggcaaaactggtttggacatgcttctctcttcttgaagggctgttagagccttggcagtgtatctgacgaaagatttcactaagcaaaatgtcttcacttacaaatccagccactttgcactctcagtcagcctcaaattcatttattttctttagagtttccctacaaccacgaaccaccaagaattaaattaatccccaagagcctgagcaattatgaggatgttgaatctatccattcaaggatgtcccagcaaggactgttcattcttttaacgtaaactatttatatgttttgattctcctcatttggaagaaagaaataagttttcatatatgtatttttcagggtgtattttatatatctgtttatattacactgttcacattactattaaagcatccccattttattgtaagtttattttgcctgcttcgggaagaacaagaccaagatcccattattaaaaccaaaatcttccacaaaagtttccttttaaaaacttagattaggaaattttcagtcagccagccaactctatagcctttgatacttggtcctacaaagttttcttcccctttggtctgaatgttttcctttgtctgtgcacactctattctcctgccagcatgataatacatgctgctttgatatcaagtggcgggaacatatagaaatgtgctattggtgctgcaatttgtatctttgttttcatcaaacttattatttaccattttaggatttttttgtttctttttgggtgtttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaaatcagctgggcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtaggatcatgtttggcttttcaaaactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttggcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttttgtgttctttgcagtagagtccaaataaatataaattaaaatgtttccaattacagaggaaatattttcagtatcttcccacaaataacactgggtttataaggcttggttcccgggtttcatggtcatgcttggttgactaactttgtgttcatgtggcataagattctaaactgtcagaactacgtgggcttttagagcccatctaaatccttctcactcacagacgagcaagctgacatatttgcctcatttattggcagtgaatgaattaaaatattgtgccttcatcaagatattgtgtgtatattcacaatgttgtttttcataaatatgtagcattactctgttttgtgactgctcctagactggctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaacatatgcaaacttgtcttattaaaaagcctatctctagtggttcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcatatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggcacatacacgccatggaatactatgcagccataaaaagggatgagttcatgtccttttcagggacatggatgaagctagaagccatcatcctcagcaaactaacacaggaacagaaaaccaaacaccacatgttctcactcagaagtgagagttgaacaatgaaaacacatggacacagggaggggaacatcacatactgggtggggcctgtcgtgggggtcgggtgcaaggagaaggagaggattaggacaaatatctaatgcatgtggatcttaaaacctagatgacaggttgatgggtggagcaaaccaccatggcacatgtatacctatgtaacaaacctgtacattctgcacatgtatctcaaaagtaaaattttttaaaataagaagaagttgaagtcagggtataggaatcacaatttgcagtgctatctttcacacttcttaccacctgatgaaaatcaccaaatagtatttcttcttttacctaacatctctaggaaagagagaaccctgactgcacctacaagtagggaaaggcatttgagttacgcaaagctgcttttaactctgaaactgtcctacagtgtagcatataaacagggaaaacattttattggtgttttaatagaatcttatctaaatatctggaatcttactgcaagggccgatcattactctaggtagatttcaaggcccacagctccattatgatgtcaacaaggataactgatgtttattctgtagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggcgcctgtaatctcagctactcaggaggctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaacggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatattgacactcccaaggataagggaaggcattacatcatcctttgtaatggtgaatcttgtgcatttgtagagggctggactttggcttctaccatattgtttagctctgtcaaccccacacaaggactttatttatttatttagacagagtcttgctctctttcccgggctggagtgcagtggtgcaatcatggatcactgcagccttaacatcctgggctcaagtgatccttccacctcagcctctcaagtaactagcaacacaggtatgtgccacctcatctgactaatttctttttaattttatatagatgggatctcattatgttgcccagcctggttttgaactcctggccacaagcattattattatcctcatcttacacatgaggaaactaccagtgaagtggcttgcccatcatgtgaaattacatatgccagtactagcctgttctgaaatccagcaacattcttttccacctctagccttgtttctagcaccctttggcctccagagcaagctggggttcattttacattaaaagtagagccatctgatgtggcgggcatccaaaacacttgggaaaatgctactctgtttagaactcgcttttcttcctcccgggtcccagtgcaggaggtactgtgtgctatgtgggccatcagactgtccctggccatggcaggagaattaggagaccaccagggctgtagttaactgtaggtccttcattaagaccagccaattgatagcgtgtgttcatgagtccttgtgaagtcttttcatcagccacgtggaagaccccttagaaaaacaatctctgtaatttgtatttttggacatagtgctttaggaaggtggatgtctgaaggtgggctgggtttgaaacatctctcaatgccatgggacagtgtggtacagtgtcctgacaacttaagctcatcctgacaacttaagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgatccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagcttaaggagattttgggctgagacgatggggttttctaaatagacaatcgggtcatctgcaaacagagacaattagacttcctctctttctatttgaataccctttatttgtttctcttgcccgattgcactggccagaacttccaatactgtgttgaataggagtggtgagagagggctaatttacattcccaccaccagtgtacaagggttcccttttctccacatcctcatttgttttttccagaagacagcatttgctattacctgtcttttggataaaagccattttaactgaggcaaaatgatatctgattgtagttttaatttgcatatctctgatgagcaatgatgttaagcagcttttcatatgcctatttgccatttgtatgtcttttgagaaatatctatccatatttttcgcccaattttacatcagattcttagattattttcctatagagttgtttgaactccttatatattctggttattaatctcttgtcaaatggatagtttgtaaatatgtttccctttcactggtttttgtcttcattttgtttgtttcctttgctgtgcagattaacttgatgtgatcccaattatgcatgtttgctttggttgcctgtgtttgtggggtgttactcaagaaatctttgcccaatccaaagaacattcatctttgtcaaatgagctatagaattaatgtttttcctatttttatttattcattttatatttatttctattttatatattcatataacaatatatttattcataatatcactttgaatatcatttgttttcatcttgcatttttctcatttttcattgaggcctaatttacatgcaatgagatactcagatcatgagtcgtagttttaggagatttggcaattgtatatattacccaagaaagttcccttaagttcccttattcctctttctattcaagtcccatctgccaccctcagaggcaatgactttctgacctctatcaccagaaattatttctatatgttcttttaaatcagataagaatcacaccatatttattttttgtatctggattctttcattttgtgcagttgtctgagattcatccatgttgttgtattagcagtcttcatctttttgttgtttagtatgccacgattataccataattaatttacccatttttcttttttatcataatcttatataagggaaaaacatgggaatacatgaactgtatctttggctcaaatccatcttctatcagttctaagggcctcagggtatttgccatgaggggctgtgacaccagcctggactattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaagtatccaaagcattggattacttgagataatatttctggtcctcttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggatatgaacagtaaaggagaatatttttctagcttgtgttaaatcaataatgtagtgattccaagggaattgagaggttcgtgtatttattcatatattagtcaaaaattcaaaattctatctctaattaaaaaggaatttgagaagtatctaccatttttattgtccatctctttggacatatgctttgcagcacagtggagcggaaggagcgtagacctacagaaatttagagggctaaatttttaatattggcctggctacattgcctggactttgggaaaatcacttaagctctcttagccttagtctttttatctgtaaactgagaataataatgccagtttttcaaggttgcattgaggatcttaggtaatacatataacattcatggaacataaaatgtgaaccaatgaaggtgccaatgcaattacaccttcattaggagttgtcatttctgcggcttctcattagaacatcaaaattagttccttcaatctttactgaggcgcagagctttaaactctaactttgaaacttccaaaatgaagtgtgaaaggtctgaggccttgtgagtttgaaaatgcagttcacacttcattttagaagctccagaattttttaccaaattgagattggattcaggaaatcatattttaaagccctggttcatgccattttctaaagaagtacctagaaggccataatcagaatgcttattaagtgaccacactttgaactgcattgcagataaattacctctgtgtggggagatgtgtcttgagattctgcggtcaaggctcagacagccccagagctggaaacctcagagcatttatgcctctgtcactaaaggatggggttatgggggctggacagaaagcttgagagagatgaaaagttcagtgggcttgagggaggattactgaattacaataatatccacaccgtaaagtgaatttgtacttgcaagagacacattatttatctagaattttagaaagggtctcttttcaggtcactgtgtagattgcctgtgatttgttctccttgattgaatgtgagtgagtgtgaagcatatctaaacaggtctcacagcaagtttctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccgtctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgacagagcaagattccatctcaaaaaaaaaaaaaaaaaaaagagagagaaaagaaaagttacatgtagagaactgtaagtaatcttatctggctagaatatagggtaccataggggaatgactgagcatgggtcagagttgtaaacatccttatcatgccaatgagttggatttctccagaaggcatagagagatctgtttatagtttctaggtaagaaagagtttatgaacttgcctgtgtcttcgaaatatgctgtggcagaatagaaaaggtgatcaaccagagtaggacagaggccacacacatctgccctgaggtcagatacctatacatttattgtgtttgatagccaaatgattttaatgtaaactagttgcaaacatttaaaatttgggaaattttacataaaaatctagattttcgagcttctattaagaagtagagtgcacaatatctgcctagcaagaaacagctgttgctgagaagtgtcttccaccttcagctagagcatgcagtctgacatttgcttttctggttcttgtatttgagtgtgagactcttggagtaaagcaaacccagggtcagaaagatcactggtgatgatgttgcagttgtactgtcaggactgatgaaaacctaaactaaggtggaagccttgaggaatgaagaggagggcaaggatggatttgctgattgtttagatgtgtcatggatgaaagagatggagaaatcaaagaagactctcaggttgtaattttaggtaactgggtaggattcccatgtagtcagaaacccagaaagaagagaaggctttgggaagatgacagtgtattcaatgtggctttttgtggttcaagactttggaaaatattgattagactgttgaaaagtacttataggtcaggaacctggtcagaaagtattgtgctaaaataatattgttatgacccaagcagttgtaaaaataacttttattgtctaactctcacagtttatcttgaactcttaacaggttgtcaggcaaatatctgttcttgaaaccagaaaaacaaatcaagaaattgggatatttgaaatgcctagagtgggcttataactgtaaatgatattttacaatggaaaagtagaaacagtctttagcagccaatgtgaaataactgggtaatgttatttaatagaatgcaaatttgaaatgagtgataaccattatggagaattttgttaggaaaaaaattaataaagtgaatgtaacacatgaagcagagctggaactaggaagaaggaagtcaggctcctggggaaccaaattaaggagacttcccctctcaggcacttgtgggaccctgacggtaagcatctccttaggtactgctcccatcctcatccttgccttgagtttttgaaaaatatatgttagaaatgtttatgattatatatcacaaactgttattctcaattttatgaaattccctagatatgattacaatagtcatttgagatttatgatcttatctaattgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgcgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattcttacctttaaaagttagctatacaagtacatcatataaatgtcatttactttgatagctgtttatattttttaaaaaaagaaagaaaacaagactggtagagaagatagtctgaccgcaagatcaacaataataataataatgtaggaccacagaaaagtaaatgaaatcttggactgcattcatctaaagaggagcatgcagaacagggaagcagcagtgcctggagtgctgagttcagttctgggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctctttagggctgttaaattgaaaaggcaacagatttgtctggagaggacagaagtagggccaatggggaagaagatatttatgtcaaaataagaaagctctaacaattagacctaccagtggaatgaacgaaccaagagagtgagctgtccctggacatggtataagcagcctcaggggctggaaaaacactgactgactgggaatgttgtagagggaatttatagatcagattgattggggaaaatagccccaaaggttctcctctctctgacatcactctatgattctatgtgaagttctagctttttaactatttttttgtataattaaataatttgtctttattgattgagaactaatcattaaaaaagctactgtcttttcatgtctagagatgataagaataatactacatgcttttgaagaaaaggaattttatgcaaataatcccataccagtgtattacgcttttgcagggataatcaagagcttgcaaaatttgaaaccacattttcccctgtatggaggaggaaagtctattttgcatccgtactttatgccttgggcattattattgctcatatgctctaggatttttaataaacctaacctgcttcatgaaattacactgcattaattcaacatggccatgtccaaaatttaatattcattcatttattcaagtatttattcaacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaagaaatttgattgtgtctcaagtgggcaagtttggcttggggtctttcatgaggtttctggtgtgaggtctctcaaaggctgcttctccttacacctgggccaggagtgtttgaacagctagtctggaacaacttggggtcttcaggtatctccctctatctgcatgtggtctctccagctttgggataacctaacttcttacatggtaactgctatagtttgaatgtgtcctttaagttaatgtgttggaaacttaattcccaatgcaacagtgttgagaagtggggtataataagagatgattaggttatgagggctctccccttatgaatggattgatgccattattttggaagtaggttagttattgagagagtaggatgttataaagtgagtttgactccctcttgctctcttgctgtcatcctctcttgaccttctgccttctgccctggaatgacacagtatgaaggccctcaccagatgctggcaccatgatcttggacttcccaccctccattatcataaaccaagtaaatttatgttgttcaaaagtgacacagtcagtggtattgtattatagcaacacaaagcaaactaagatagcaactgaggacttcaaaggtatgtatttcaagagaaaactatatcacattttaagattagcattaggagggctgggtgtggtggctcactcctgtaaccccagcactttgggaggccaaggcaggtggatcacctgaggtcagcagttcgataccagcctggccaaacatggtgaaaccccatctctactaaaaatacagaaaaaaaaaattggtgagcacagtgtcgggcacctgtaatcccggctactcaggaggctgaggcaggagaatcgcttgaacccgggaagtggaggttgcagtgagccgagattgtgccagtgcactacagactgggcaaaaagagggagactctgtctcaaaaaaaaaaaaggttagcattagaagtcaggcagcatcactgctatgacattctcttggccaggcagttgcataggttctcccaagacctcacctcttagtggtggactgttagtatcacattgtgagatgggatgtgttttggtgtagtcatctttgaaaattacaacttgccatagcatatgaacagataacactatacttgggttctctgctatggtgctgtgaaagaacagaagaggagagtgattaacagaagaggtaacattcacatatcatgggccatataatttgatgtatgtaacttgttaaggaaatacgttcaaggcaggggcaacagcaggtggaaaggcatgaaagaacaatgagcacaaagtgtttaaaagcttgggttgacaggaacaaagactgagttgtaggagaggtgacaggctaggggcctagacaggggaggtaggacagcatcctgaagggccttgaacatcaagttaaaacgtttggctttggggagcagtcactgtctttagagcacaggcatataaactgatcgtctttggtaatctcttccatctacaatctttctttcctttgatagtaaacatatcatctctgttaaagttgcttcctagcttaaactgaacacagactccaaaccattgaagcactttagatttttttcttttttttttttccttttcttttactcaccacaaacaactctagaatggcatgcatttgaacaaaccaaaagtgatttcactcttctaattttcagtgctttttggctaaatgcagagtgagaaattcatacctttttcaagcagtgtgggttctttttcccaatttctgtcatccatctggttctctggaggtcttggaatccaggaaagtgttagttcactgtgctgaaatccaaaaaagactgctaaactgtgaaagaaaatttgcattccagagacactgaaagagttagtccaccacccttttgcaacagcaaggagaaaacatctgtatttcctgcctctttgtctttaagcagttatagaatggaaaaccctatactccctggctgtgcgtttcatacctagttaatctaaatcacttttggcagggtgggggaggaatcaaaacatggaattattttatttctagtgtcagaaaatattacagccaagatactgtttaagggaagcaaattacttcaccagcttccttttgagctcctcatgaggtttaattctcatgaatgggtcctagagccgacatttgacatacacatcagcagtgccctcttcggaagggaaccgcacagtcacagccatgatgttggcatgtctttatggccttcctaagtcatgtgctgtcttttgtcttccattggcagaaatacaattagaaggccttgttctcaacagaagccaaatgattgccaaatctgttcaactgatctctagagaattgaagttagctcatggccctctggctgttctctttgccactcccaggagttataggcttaaagttatccctttcttttgaaagaggatcaagtttggttcaaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtatacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttataatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgtgcaacaatcttgttttgacagcgacaaaacccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgtatggatttggggtataataaggtttacacagaagaagagctttttcacaaaattcccaggaaagcagggggaaactcacttagaaatctagaagcccattttatattatgacattatccaattatcccagagtatcatatacacaattccttagataatccatttgttgaaaggacagatataaaatataggagaattaatggtgaagggaaaaaatagaaatacggtgcttcagtgtggtagttacattaaatgatcaaaggatgacaagttaattgaataaatgtcttagccccttgaaatttgtatagggaatttataaaactaacatttattatatagtcaggactgggttctcgctttgataatatgtgaactcatttaaacctcacaacactgcaatgtagacatttcagtctacaaaaaccaaaggccagaaaggtcaagaaaattgcctagcttttcgaacccagatcacctttttcctactgtttcactaattctcttactataatatggcagaccttctttgatgtctgagttaataaatcttcacatgacttatgttgtaaaggcaaaatctatcatttgacttgtctcggaaggaaaggaactcaattcttttctttctctctcaccatagtcttagtcttctctgatatgttcattatgcccatggcatgagggtctgacccacagtcctcagctcttaggccccttccccctgccccacatttttcaaggatcagaacacattcaaaagaagtgttttggaagacctagcatgtcacatgggttatgcattttaaagtaaaatattacctctccgggcattaaggtataaataaactaaatgttctataattgagattttcttttccgatttagtaaagctcagatcacaatcctaaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagttttttttcaagtgccaaatccaatcccaactagaatagattcttaagagtcatagaccaccaccatactgcctgctctctcaccattcataagtaattactctcttctctgcattcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcatctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatcatttgggaagcaatcttgatgaccagaatcaaggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattacttatgtaaatgaagactgtatatcttgattttaaatactcaaaattgaacacttacatatacctatgtaatatgtaaataatggtaatattcttattctttatcatctcattagtagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactctacgtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttcttgataactaactgtgtgcaaatctgcttcagaatttgtttcctaggaaacacaacctcagactatggcttcatgggaggagagaggagtgattgcagtttagtcatagaggttgacataaaccactaaatcaagtacattgtgttcagtgtcataggggaagcataatacaatcctatgggagtggaagaagttacttacttttcttggaatacaacagaaaaagatttaggaaagatttttcagaagaggtgacatttgagtttcactttgaagaatgagtaggcattctctaagcaaagtagaatacaagatagtctgggctggtaaaagaatgttgcttattaaagatgtggcagaaagctcagtgtggcagctgggaggaggagtccatgggaccacgatggagctggatcagcagtccagtcacaaagcacgctactgatattgaaggttcataagctggaaggtgctcttttcttttaaatccccagctatcaatgctggcaaccctactagacaaaaaaataaataaataaataaataaaagaaaaaagaaaagaaagaaagaaaaagaaagagagagagagagaaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcgtgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggataattcatattcttcacctagcaactttcctttttcatggccacataatgaattccttagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccattacagggctgactaaaaaaaaaaaaaaaaaagtaaaaacccacagaggagcaaaacacaagtcctgggaagacaatttccagccacattagctcacattgtcagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattcgttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggcacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacagacacttcttgcttcatagccatttatatatcctcatggtaaaagagcagctacccctgaatttccacatcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttctacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaactatgcccatgggtcaaatccagcccattgtctgttttttttttgtaaataaagtattactggaacacaagcatgcccatatgcttgcatgctatgactgctttccagctataatagcaaagttgacttgttacaacaaagccagaaatatttactatatgggactttagagaaaagtttgccatcacccatgctgtaggaaacaagggaaggaacaaggatagcagtcagaaaacacatgtcctcagttctggacttgccacctactacctgagtaatactagaaaagccacttgacccatctaattgtgtttccttctctctataacacacttctttggccagtttgttagttaattggccgataacacttgttttctatttgtaaggactgtattaaagctgtagatgtggtttgtaaatggtgataaatgccttccttagagtggtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcgtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcatttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaacctctgcctcctgactcaagcaattctcctacttcagcctcccaaggagctgagactacaggcatgcaccaccatgcccagctaatgtttgtatttttagtagagatggggtttcgccatgttggccaggctggtctcaaactcctgtcctcaagtgacccacctgcctcagcctcccaaagagctggtattacaggcatgaaccactgtgcccagccaacgtttggtttatatttttaagaactgtactaaacctatagatatgatctgtaaatggtggactcaggtttctgtatgtgtttgctgggcagtggctttgaagacagcctttgaggctatcaaagagatgaagcttgtattgctcaccaggttgggtatccattctatggcttccaagtgtgaagtcttctgggttaattctcaccactgtgttgattgtcaacagccaggaagcacttaccccaaggagtttggagatctgagactcatattttaagaatgaatgtcctaaccactttccaagtagcaaagaaagtgaaaacctcaccaaaagacgtgaggttgaatgaattaaaaaatcccagaggcggaaatttgcaacctgaattagacaaggaaggactcacttttaaagggcagtcacagcataaattgtgcttcacattattgatatttttagcttgtaattacacattgaaaaatccctgcgtcttaagggaagtgaaaagatctcaatggggagtatgttctgttactgtttctctcctttcttagacttatcctaatccaagaaagactgatacttataatcggagcacacatgtttctgtggctagaaaagactgatacattacacccctcaattaaaacaggaaatcaattttgacaaatgccaatttatatctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttataagccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagcttgccaggaggagggcagagaaagtgtgcagacagggagaaagggctgaactccatgagacaggcacaggtaagggcttgcactgtcaaagtcagatcacctggctctgtggtcagaataggctttgtggacggagaatgtcaagagtgttttaagtgggaaacaaggagattcctggcagagggaacaactcaggcaaaaagcagaggcacagagttagtaaagggttctctgtgttcagggagatttgctttgctgtaactagagcagcctgggagtagagattaccttgagatacaggagacccataagaagggatttacctcacctgcttagcctgccttttatttatttatttgtttattttatttatttattttgagatggagtctcactcttgtcacccaggctggaatgcagtggcacaatctcagctcactgcaacctctgcctcccatgttcaagcaattctcctgcctcagcctcccaagtagcttggattacgggcacccaccaccatgcctggctaatttttatatttttagtacagacaaggtttcaccatgttggccaggctggtcttgaactcttgacctcaggtgatccacccgcctaggcctcccaaagtgctgggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatctttcacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgtatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatcgaaagttgttttcatcaaatttacttttacgattattgtccactcagtgagctaagccttgaaatagaccacctgggattgtgagccctcctcgaattgctatcggaggaacactgtggggactatgagaaccacctcctgcctcttcgctttggtttttctcattatggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccacttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccacctcttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctgtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactactaattgctcagtttcctgaacgcctctagagctgcagtatatctgcatgttcttttcagtaaagccaaacttcccgcagagtataaccattgctgctattgtgttctggataccccgttaacttaaatttcattctatgtcaaatgaagacatgaactccattgacctccttgccaccatggtagatagcagaggcgaggttcatagctgttgtggcctttgagagtttatactaaagttagcaaacacacacctcttgatgaagtactatgtatttattttccaaagaaacttctattttctccaaagacaaaggccagcatttaactgttatataacacttttcaaaatggaccctaagaggagctgtcagcggtagtatattcctttacagttatgcagttctttgcatttttttttttgatccattatcttctttgatcctcttaacagcttggtaaggtagaaaaggcagaagttattttcagagtggcagtcggcctgtgtgcattgaggcagactgtagcaaaactgtgggtggtgctcaggaggcctgtcccctggactagcaatctttgctctccacaatgctgtctcctttagaaagtacagcaaaccactactccccacaaactttaggattttattttcttactgcagttgaagtaaatacaccgaacccactggtggcccttctgcttggcagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatgggagccaagatgggtggcctcttctcttcttatacctgtatttcatatcaagtgagcttaggaggattatatttatgtccatttatatttatgtccccaatctctaattcaattacattcaagatatactatgttatatattgggagaaaggatacaggggattagcagaatgtaaagcaggaaggatagtaagtggccacattatggaggccttgaatagaaagctcaatcatgatgttctccacatgtgtacttaacgtttttacttatgtcgtttccatctgtctttactgttctaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 868 - DNA, 677741 bp, Homo sapiens
ggtcacttttatttgggggtgtggacagctgctttcccaggggagtacttcttacagtgggatttcaagacaagatcggcctgaagaaaaattatatttgtatattttttaaaaagtaggtatttcctctcatctgaggcctaacttgagttgggtagaaagacaatttgggagtgctgttgtctgatgattaaggctaaagcaacaagctggaagggatgtcgggatgtctgtggacatgtagggaggggtagttttagcttgaaaacagttatggtgggatttaagagtatgcaaaatgttgatgtgtagcatttgcacagcatccacggtctggaataccttgtgtgcaggtcactgtgtagatttgatgagttgtcagagttggaagagtcctgcagagttttcagcacatctgtctaatttcacagtgtgagataatgggcagcagagacccaggccctgaagacagatggctcattatgtgggattagaacccagatcttctctctcagttcgttctccttcccctagacttaagctgccccctctattgcgagatgaggaaattgggagatgttagaactgtccacacttactaatctagttggtgggaaattgaggactagaacctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacactttacctaaattattgtggcactatagctgcctttgagtaggaactattttttaaaatattatttttaattttggtgtaatacatataaaatttgccatcttgatggtttttaagagtacagttcaagcctgggcatggtggctcacgcctgtaatcccagcactttgagaggccgaggtgggcagatcacttgagcccaggaattcaagtccagcttggccaacgtgatgaatccccacctctactaaaaatacaaacattagctgggcctggttgcatgcacctgtggtcccagctactcagaaggtggggatgggaggattgcttgaatccagggagtggaggttgcagtgagccaagattgccccactgcactttaacctggatgacagatcgagaccctgtctcagaaaaagaaaaaaaaaaaagagtacagttcagcagtgttaaatacattcatattgctgtgtaatcagtctccaggcctctttcatcttgcaatctgaaactttgtacctataagcaacagctacccattttcctctcctccagcccctggcatcctccattctactttctttctctatgaatgtgactactctaggttctgtatctaagtggaatcataccgtatttgtctttttgtgactggcttatttcactaagcgtagtgtccttaaggttcatccatgttgtagcatgggtcagaatttctcctttttaagggtgaattatattctgtggtaatgaatataccacattttgtctatccatttaggtactattttttaacctccatgttatagaagaacagcaaccagagacttcaaagggttaattaagtaagtggcccaaagtcacatagtcagtagtggagactaattttacctaagaatggcatgtgatcaggagtaagcagatattggattctaattggcaagagtgtgacaaatcagggtgcttctcaactggatggtgacacctccttacaccttgctatggcatttcaataaagcaagtgttccaaagggctgtacgcagctatgcttcctttcttttgtattgggctctaggaagcccatagctaaatttaaagctcacctctagcaaatggtatgagacatccagctcttattttttgtatccctttctcctttctttgctttattttctcctctccttacccactttctcacttaaatcatgaactattagcatcttttgtcaggtacctcagatcatttctggaacaaggcagaatatatagatatgtggcatgatatctaatattttagtaattattaagtctgtggaatagtaggccaaaactggccatgatttttctgacttgactctgctcgtcttcttcttcttccttttttttttttttttttgatggagtctcactctcttgcctagactggagtgcagggcgtgatcttggctcactgcaacctctgcttcatgggttcaagccattctcctgcctcagcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatcctgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatctaattttattaaatctttattgagtttccacttaggtgccttgcactgttctgggcattatcccagtactcgatttagagcaaagagtaagacacacacaacaacgatctcttggtgcttacacgctgctgcaggtgtgtgaaggaggcagataaaggaacacttaaacaagagggactgataagtaacccaagggaggagtcacaaagggcattctgactgtgagtgagtggggaaggactctgggaggttatgtttaagctgagatctgagtgacaaggaggccaccttgtagaagttgggggaagagcactgcaggcagtggagacggtcaatgcaaaggtcaaggctgtgaagtgggaaggagtttgtgtttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggcatctttccagctgctgtggagggaacctgatagtaaaagggagtcaagggtagaagcaagaaggttaggctagacttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggatggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggggtttgaaagcctctccttgtcttgaggactggactgcggtccaagggcacctaccagccctcttttttcatttacatttgaattcacagttgctgccctttggcagttccctgtaattccttttaacaggctgggctttcctgcagatacttcatttttcaggtcttggagaagttaggtagtggctgaatcaggtagagaatccaaaattctgaccaagccccatcctctagccaccaggccaaagcaacttagcttgtgacctcatcctcctgtgtatcccctggcaatcttatactataatcagcctaagcccagagatgctcagaaatcatacactaagtcatctaaaactcatttctgaggctttctcatgcgcccctcttgcagtctgtagttaccaggttttcaaataattagcataatctcttaaaaacagtgttttgttattgctcattcaagtttcttctaaaatttcttttatattacctattcattgagttgacaaacatttattgagttcttactgtatgccaggcattgtgctaggtgctggggattgattcaaagataatttggaggcgtatggaaggggagtggataattacagcacagtgagataagtgctataatagggggatatataaagagccagaaatagcactatgaataacatctttgaacaaattgccttcttttttccttttggattattcccttatgtatattgcccaaagtgggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattatcgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatattgacctgaaaggacccaagggcgcattattcctgaccctggctcaggtgctgaaaggctatttgcatagccctactgttagagcacagaatcccaagtaaagctgaaaccatgccacagttttgctgtgaaacatttattacttttctagtacttaacagtattaagtaaaaactcctgcccctggtatccaggacctgtcataaatggacaccaacatcggtccactgtgggtccatgtgggtccttgatgctcctgcttacatatctttaaatcaaacacatttcctaccaacccccagatatatcttgcactttctcaccttcatgccttagcacatgcctttcctttagcctgagataacctctccaatcttcattcatagaactcccaatcctcctgtaaacttctgcacagacgccatcttgggaagggaataatccttgatcaccacctgctctcccatccattagaagtgatctctgtgttctctgttctgctaactcaaccacagttagctgtgaggcaatagagtacaaatgtatgctgcatatgagcatgggatatggatttgaatcccggctgtgatacttcctcactgtcagttaacttgcttgagcctgagttttcccatctgccagatgggtgtgatacaataggtgctccccctgaaacccaccatgttgacaggagtagtataaaaatggtctgattctcccggtgaggtcacgtaaatctggaatcgtcaacaattttcctttcctttgttgtcatgacttttttttatgacatcacctcatgtcatgtcaccgtgtggtatgaaaatttgcattgttacctgtgcttcttctgtggcacttgtcctcccttacttgatgtcttatctctccttctagactgggagctcttcaagggcagggagggcattgcatctttgaaggccttgacatatggatactgctacaaagtttcctttaagggaaaggaggattccatacaacctaagtggtgacatcagcacaggctcattactaatctcatgtcacgaggtttcaggcctggctgagaactctgtgagctctgtgatgttgagcttcaggcacatagagtacaagctgggtaggcctctggctcctgcttaagagacagcagaaaggctggatggagcctgtctccagaccagcttcttctgattcaaggagttgggtgggactggcagttcactgaaggcagagtggtagtcctgcttggaacgtgaaactttgtttctttcctgggccttccagtgggtctgttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaacgcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacagtcaggagacatacagtatctaacaaacttagggaatatgcttggcttacaagacgtggttttagtccacataaattagaatcacagaactataggctttgagaaattataaaagccttggaaggggtgaacgtgaattagtgcatattgtgtgcaggctttgtgccatacgtgctagatatgggatcccaggaaatggttgcatacaccttgttgggtagatgatattaaccctgttttgcagacagagaaacctgagctttgagaaaatcctttacacaagtccaatatcaaagtctggaacttcaaactgcactcctgatggcttctagaaatcctttccatttacagatatgacaagacttgctttcacattgttgattttttttttatcctctctttctctgtctctgggggcagcactaattcagggccagatagaactgtgaaaatctgcagtgttgatgtcacataacttgtttaatgaatctagattagtgtcttgacttttcctgccaagaatctgctcataaagtgtcttgttttgagctcctttaactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcggtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaaattgagaagcactttaacaactggtaatttaaattgcgtttgaactctgctaatggtttgtttgcatgggaacttcaatcatttcacagtggttctttagcaaagctgcttgttctctttatggaaaataagaaaaaattattaaaagagaagttggctatggaaaatggagaccactttcatttgtgcctggagggaagctggagagtgtgagtgagactccctcagggccaagggtggagagctcttcctttcagtgaagtttaaaaatctgggaagtcagatgccctttgctgctgttgtagaaactgttgtgatttgtatctctctctgcaaggagaagctttggttttatgcagcttgcgggtgagggtagggacaacctttttcgtttgttttatgaaattgcattgttcacaggtctaatgttggcttcctaacaacccatttctcagtaagtttgaaattatgcctctctctcctttcagtggaaatggctttcagaattccaatgtccttgaagaccactaggtctcaggaaactccttgcttttctgggctgatagtgattatactccattttgcctacttaatttctgtctgctgttgaggttactgggagagcgttgaaataggtgttcgaggcctggatttgtaagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactcgtgatcgtgaggacagcaccaagaggatggtgctaaaccattcatgagaaatccgcccccatcatccaatcacctctgcaggccccacctccaacagcaggtattacaactcaacatgaaattcagaggggacacatatccaaatgatatcaaggacggcttactgggaaatgtcaagattgtttatccctctgctgctcactgattctcacttttcaggcaaggaaactaaagttcaaagaacattaggtcctatagttagaaatttgtctccaaactcatattccttttctttttttatttggtatagtttaggtttatctgttaatttttttcttccctacaatttgagtatctaactgacttgcctctttcacctccattattaagatgaagctgttttcccaggagaactaggagagctgagatatgaacactgaggcatcagcattctctttccccatcattctgagtcaaattagtgaaataagagtgccaggatctgactaggagtttaggaggtatagaagtaaaccacggcccagtcagagactttataagcctgggaatttctgaagctggttaagaccctagagatacataagcaacacccttctgtttttcataggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatgcctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattattggttcccagtgcatatgaaatttatgtttacactatactgtagtctcttaagtgtgaaatagcattatgtctaaaaatacagtatacataccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgacacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggtaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctttctctttctttctttctctttctttctttctttttctttctttcttttctttttctctttctctctttcttttctttttctttcactctctctctctttctttcttctgtttcccctcccttccttcctcccttcccttcccttcccttcccttcccttcccttcccttcccttcccttcccttccctcccctcccctgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctttctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacatgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttatagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgaagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttcgctcagactcaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggatttttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgtcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaagaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatctttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaactttttttttctttgaaacggagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccccccaccctccaactctgtctctctctctctctctctctctctttctctctctctctctctctctctctctctgtctgtcctcctctcctgctgttgccatgtgaagtgcctgctcccttttgacttctgccacgttgggaagcttcctgagcctccacagaaggagatgctgctatgtttcctctatagcctgtagaactgtgagccaataattcaacaactcaaccacttcttttcttttctttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacccatttcttaatctctctaagagacatggactgtgttaaagtgtgtttatgaactggtggtcgagggtgcatttccctcctaagaaaactcattccttgttatgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttattctccattcccatgatttagccctctaacttcatgcatttctttttgccctttttcttgtgctggattttagcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacacgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacccgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaatttgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagtgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttatatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttctgaaatttaaaatgggcatctcacttctgtgttccctccccaaataaatgtattgatactaaaaaggaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttatttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagtggaggtgtaaaaactagtcttccagcctccagtcctgtctcagcattgctccccttcacgtcgttgtccagagctcctggtggagccttggccttttccatatgtacacgtgcacacacacacacatacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctctctctccaccccccaccccccacccccacccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggaggttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttctctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagcgtcctgaccatctgtttctttctaccccaggcccattcccatcatgagtatttattctgcccagtgtgggatgggttctgttctagaagtttgcatgagcagagggaagcttagccccatgaggccagtcatgaggctccatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccgttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccatttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagactttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattctcagggagtttagagacaacataatgaaggtattttcaaggtttggggagctgcttggaacttgattttggacaaaatggaaggaaaacaaccatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttgtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcacagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggtgtgcaccaccatgtccagctaatttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttctctcctcctcctcctccttctcccttctcccttctcctttctccttctcctcctccctcctctccttctccttcttctttttcttcttcttctttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacagaaagataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaattttttttttttagttattcttattttctaattattttatatgctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttcttttttttttctgttttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattgaacaatgagaatgcttggacacaggaaagggaacatcacacactggggcctgtcatggggttgggggacgggggagggatagcattaggagatatacctaatgtaaatgacgagttaatgggtgcagcaaaccaacatggcacatgtatacatatgtaacaaatctgcacgttgtgcacatgtaccccagaacttaaaatattaaaaaaaagaaaaaaaaaagaatttgcatctatttttagactttctgttctattcatctgtcacttcatgtgtcattattatgctttcaattattgtagctttataatatgttttattatctgacaaagattccccattcctattagtttctctttttcagaaaatttctggcttttaatgcctgtttatttttcattgacctttataatgaacctatctagttctggctgggcgtggtggctcacgcctgtaatcccagcacttcgggtggctgaggtgggcagatcacttgaggtcagaagttcaagaccagcctggccaacatggtgaaaccctatctactaagaatacaaaaattagccaagtgtggtggcgggcacctgtagtcccagctactcgggaggctgaggcaggagaatcgcttgaactgggaggtggaggttgcagtgagccaagatcccgccactgcactccagcctgggtgacagagtgagactccgtctcaaaaaaaaaaaaaaataaaataaaataatgtaaaaaagttctgttgatatacttatgaggtttgctgggtttatttgttagcattacatgctatacattgtaaaaatgttgattctttttcttggaatactaatgcctttccatttgttgaaaccttctttgatgttcccaggagcactgagatttttcttcatgtagaccgtgcctgtttctaataagttaattttgtagatattttctacttgctctagttaatgtaattattttctatttcatttaattatatgtgtgtgtgcctctgtgtttggggtctggatttcagtacattgattttctgctcagccactttactgaattgtctcattatttgaataattttagataaattttttttgagtttctagttaagtaagtatattatctgccaataatttatcctttctttccaatttttacaacacttatagctttcttctaactgtactaatacctctagaatagtaaatattaaataactgtggttgagtaaatgtccttcttttgtgtctgagtttaatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaacatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaaccatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggaggttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggaagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaaaaaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagtgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttaggcatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaaggccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttaaagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctaactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagtctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcgcaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgttttcccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgttttttttttttcctttggatatatgaccagcagtgggattgctggatcttacgatatttctttcttttttttttttttttttttgagacggagttttgctgtgtcaccaggctggagtgcagtggtgctatctggctcactgcaagctccgcctcctggcctcctgggttcaagcgtttctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtggttttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcctctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggaatggtttgagacataatggtcattgtgatttttcaagctataaaataaagcatgatgttaaaagatgattaatgttttcatttggtggtagatgacaagtttcttgcagggcatctgatcaatcatgctcttttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgcgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatatatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaaacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacccacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctagtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcacgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcgaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttattttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctaggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttctttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggctttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactctcacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcaatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagaggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttttttttttttttttttgagatggagacttgctcttgtcgcccaggctggagtgcagtggcgcgatctcaactcaccacaacctctgcttcctgggttcaaacgattctcctgcctcagcctcccaagcagctgggattgcaggtgtgcaccacgacacctggctaattatttttgtatatttagtagagacggggtttcgccatgttggccaggctggtcttgaactcctgacctcaagtgatccgcccgtcttggcttcccaaactgctgggattacagacgtgagccactatgccaggccagttgtgggaattttataagggctttttcttttctttttttttttctccctctggcctagtttgtggggagaggtatgtttccccaaagatgtggagttagcctgttgatgtaggcatgggagagtgagcttagacagagatgcctctcatataaggtagaaagccttccatgcccaacccaagtgttgtagaagttgaaaggggaaaaaactttttcaaaattggcttgacagcaaaactcctctcagtgtcttcttttttgtccccctctataaatggtaggttttcgtagtatcatgaccctttttagtaattataaattaatataagataaatttatggtattccttactatatagatttgttaaaataattcacgatatttcatatgtacacacaagctccttcaatccaattagtaagaaaaacacttcatgtcactgttaaataacatgaaaataaacaactggttaaaaaacaaaacccaaatacaaagcgttgagcttcctactggaatctgaatctgggagtgtcttgttgtaagaaatgttttcagacctatcattttcttttgtttctttttctttttttctaaacagactcttgtcagttctcttctgattagtgttcccctgggcttttcttcccaaaataaagttaagtgcattcaagtttctgggatcttctttacatccttttgaaaatgcagagtaaatattatgttggcttctttttgttttttttttttaaattttattattattatactttaagttttagggtacatgtgtacaacgtgcaggtttgttacatatgtatacatgtgctatgttagtgtgctgcacccattaactcgtcatttagcattaggtgtatctcctaatgctatccctcccacctcccctaaccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaactcatcatttttatggctgcatagtattccatggtgtatatgtgtcacattttcttaatccagtctattgttgttggacatttgggttggttcgaagtctttgctattgtgaatagtgccgctataaacatacgtgtgcatgtgtctttatagcagcatgatttataatcctttgggtataaacccagtaatgggatggctgggtcaaatggtatttctagttctagatccctgaggaatcgccacactgacttccacaatggttgaactagttcacagtcccaccaaaagtgtaaaagtgttcctatttctccacatcttctccagcacctgttgtttcctgactttttaatgatcaccattctaactggtgtgagatggtatctcattgtggttttgatttgcatttctctgatggccagtgatgatgagccttttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagtttccccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcgtctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtgctgaaaaaaatgtgtattctgtcgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgcctttttttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgagagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcggctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcattcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcaagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaaatagcatttacattttggctcttgaaataactaacagcatgtcatttccaaagagacgttaatcattgataccaccagcagcaaatgttctcattcatcagaccacatttgttttacacgttcctctccttagaaagagataagtatggtttcttttctttagttcttgctaataggatacccaacatattgaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtagtgtatgtatgtgcatgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaattcaaaaatcagtcaggcatggtggcacatgcctgtaatcccagttacttgggaggctgaggcaggagaatcgcttgaaccacgaagtcggaggttgcagtgagctgagattgcgtcactgcactccagcctgggcgacagagcgagactctgtctcaaaaaaaaaaaaaaaaaaaaaaaaaaaaaaaaaaaatttcagaagtcccggagtcctttccatgatgcatttgaagggccagagagatagaggcatgccctatgtagtacatcttgctgctgtccctcgtgtgtttaccctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtgcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcgtgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggcagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacatttttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagtcttagtattttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaacagcctggttcatttttactgtgttgccattggttaatgcttaaccagattttgtctctgtttcaaaatcttgaaataaaagtggaacaacttccaacatgacttaagaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccgttaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataataatcaaggacttagaagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggttctctatgaccttttagctcttaagtagtctgtcctggctattgtcaaccatgtctttttttccttgactgatagaaactgtggcaaactaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacgggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagccaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgtttaaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctacgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgactgtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcgagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttgtatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttccttggagaagttagggaaatgttcacagagttagagacatttgagctgagacaatataaaaatatagggcttggtagaacgtgaagagagggaaacggcattgttgatggtgaacacagcatgagcaagggttcagaatcatgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctccggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggcctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaacgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttttttgagatggagtttcactcttgttgcccaggctggagtgcaatggcattatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataactttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggcggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggacaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaattcgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacatactttttgatggcattgtttgtttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaatgcttttctttatcaatgttgaatattggcccccattctcttctggcttgtagagtttctgcagagagatctgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgacctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaatcctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcattacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcatatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattcttttgtagtgttgcttacgttttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcccaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatggtctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcctggcagggttatcttacgctattgaacctcagtttctccatttatccaatagagatggaaagtattggcctgcatttatttctccttcaaatgacatattgtatagaagcgtatcgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgatttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattacaccatagcagtccagcctgggcgacagagtgagactgcctcaaaaaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcacatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagacagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgaatacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctgtgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaaggtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacacttcctttcacgtttgtaaactagttatagatttggtacatgtagtcagtcactgtgctaaattctccttaagaattacgtctcttttttgaaaaactaacttttaaaatagacattattattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccatttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttgcaagagtccaatgctgcataatattaataaacttaattttcttaaattttcttctctggcagagaccataagcagtatgatatttagtcatgctaggataagacctgagtagaaattgtactagctatccagctcgtttgttaatttacttttgatgaggcagagaacggtcatttaaccagcttttgttcagtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaatattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgatgagtgggttgggattaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatatgctgtgtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtacgatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaacaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtaaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacattctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatataggtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacgctccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacatacaggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatgcagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcaaactgcctggcatggtgcgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaggctactcctccataaatagaaaagatctcttctccaacacatcaaaaacattatttttaataggaaaataacaaataaagaacaggttaaaaggtagaagtttctgtttccccaatacagttttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaatggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccgtggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcagcagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggtaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcatttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggatatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacgcggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtgctcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatcgttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctttggcttttccacattaaatttctcctcttggtttatttttcagagtactctatgacctacctcatcctatgtagcacactgtatctcccactgtcctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgtttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccctgccttcctccctcccctctctccctccctccctcccttgtccctcttgcctgaacttcatatcagtgtgtcttgaatatttgaaaaatatttataggaaagtgaatgaaacctatcctaaatggagaagtagatggcaaaaaagggtattagagcttggcttttcaattgtaattgtagccatgacctaatttttggtaatctaataggcccatataatctctgcttggtgttagaagggaagacctttcaccttttgtgttttcttcctaatgtcatgcaaagtgctagagctttggagcaaaatgtttgatttccaaattccaattcttccatttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtttcaatgagccaaggttgcagtgagtgccattgcgctctagtctgggcaacaagagcaaaacccggtctataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggtgttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgctttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgaggctctcatcagaaactgtctggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctctttccataaaatgatatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacatggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagaaggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacagttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagaaatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccgtccgtccttccttccttccttccttccttccttccttccttccttccttccttcctctctctctcttctttctttctctttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaggtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttggagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatctgaaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggttgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttgtgtgaacctgtccatgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccaagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgcgcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaagaaaacagaggactattatgttactatttcctaaataaagaccaatatgataaattccttatattcagtgagaggaaagaagttgcttaccgaatgtactgatatatgcttccttttttcagaaaacaacaacatcaaccaaaacacctgtataattattacatgaatttttttttttttttttttttttgatatggagtttcagtcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatgtcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgggccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttaaaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtaggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaatattggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttatggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacacacacagacacacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttaattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatatgtgtgtgtgtgtgtgtgtgtgtgtggtatattatctatttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgtgtttttttttgttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaataactaccataatttaaaaatgcaaatgtagcaatgcactaaaaaatacctttagcttattttttgttaagaaacaagtgttttgcataatcagactttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctcctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaacggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggctttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagaacccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaacatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagacacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcgtaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgtaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggtcgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtggttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcacagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaataacaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaaattaaaaactattacattttttctccctcccttcctttctactgtttccctcctctcctctctttggtttccttccttcctttgttccttcgttccttcgttccttccttccttccttctgtccttcccttccctccctccctccttcctcccctcccctccccttccttcttctttcttgccctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcacttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgcttttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactctcattgggggttgggggggttgggggtgggctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctacttgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaactaggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgtaatatgtgacagttccctgggagtttctcccctcctcgtaggtatttttagcaaaatagtccttaaacattgttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttacaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgattttctgtccttttatatttcctccttccctctgagggttcacataggagcctccacagccagaggattactttcagaattggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaacgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcattttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcactggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaattccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatatacacacacatatacatatacacacacacacatatatatagcattcttaatctcatatatatataatatatatataatatatatatattatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggtttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctcttggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcattttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagctctctttggagatgagaagatttttctcaactttattatgaattccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttggtctgtatatcttgtttttcatgccagtaccatactgttttgattactgtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatatcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctaccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaccatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcaataccagtaccatgttgttttggttactgtagccttgtagtatagtttgaagtcaggtagcatgatgcctccagctttgttctttttgcttgggattgccttgtctgtacaggctctttttcatttctatgggttttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaaaaaaagagagagctaacatcttcactttttaaggaaatagacattgcccccatgattgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatactttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcgaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttccctttccctttccctttccctttcccttcccttcccttctccttctccttctccttccttccttttccttccttccttccttccttccttccttctctctctttctctcttctttggtgtgctgagaataatctgcagacagtgactctacagataagattgcaaatattttcccttccttcattccttccttctttcctcccttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaataaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcattgtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagaccccatgttgaagaataagatacatatgctgatgtctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaacctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccatttctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggattgccattaaaataattttgtgcagcagcactgtgaggactcagaatccagaagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcaggtgcggtggctcacacttgtaatcccagcactttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgtaggagtcaggttgcctataaaggcaaggatgtgcatacagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacaatctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggtttttttttattattatataaagccttgcagtgagtcatagaagaaatgcactggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaaaggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataattcataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagatcctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccatttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagtcgtcttgagacaataggttgaagctttcactacatgttcttttagcaaaaaattataaagcatagaggttgagatgggctctggaatcagactacaaagattctgatcttactgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatctctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacacaccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgttaaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcagctcttaccagtgacttcagtgcttccttatacaaggtgcaagcggtgctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggcattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcagatatgtgtcatcttaatattcctattaaccttagaactttgtgactgtgttgggattacttgacatatttgtttatcaatcaacacagtgacagtgacaacgaatgagtaaccagtgttttgtttttgaaacatttgaagaagtgttccatatttctgaagttattagtttagtttaggttagtttagtttagtttagttttaacgacagagtcttgctctgttgcccaggctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacatcatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttgaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactcttggtgttgtacatgttgtgggctttgatgagtgtgtagcatttatttcccgtcatagaatcatgcggaatactttcactgcccctaagaattatccttgctctgcctattattactttctcccccaaccccggtaacccctgaaatttttactggcttcatagttttgccttatcagaatgtcttatagttgggaccctacaatatgcagcctttccatattgccattttactgaataatatacattcaaggttcatccatgtcttctcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttttgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccttcttcttcttcttcttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttggtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggaacagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccagcatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaagcaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacattatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgatgtgaaaacttagcttgtccagccaaactggaggaaggagaggcgggacttattggagtaactgaaaagagaaaaattggaatatgagcagtaccaatactcagtctcttaaggaagggtagagtccctttctttctgtctctgtaatttttttcttttttgtttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcaattggttttgttaacactgctgcaccgaagctctagctgaattcacataatctcatgattttagtaaaggtaacaaaggaaaacgattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctcccacagcattagccttagttatgagtataatacaaaagaagaggaccagccctgctggaaggtaaatgaaaagatggaggaattgaacgattacataacagctgttcagacttgtggtactgattagagtcatttgtagagatgaagcagtgtgtcaagccagtgtgggctagggtatactgggaagttctcacagacagaatgaagtgggttgcggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgtgtgtgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaaatatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatggcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttccctttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcatcttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtaacaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatacgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaatactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcagacatatggagtttcaaactaacactgtggtaattgttgtgtgtctaaacaagtgacaacggggctgggcagcaaaactagacatgggagaagccaactgatccattgagctgtcccagcaagagttagtgggattatgatttatgaaagacctgtgtggacaaggtagtttggaggaactgaatggagggagtgaattaattagaagaatgagacaggactagccacaaacttctcctagaagtttaaactattttaaaaataagagttgtggctcatcaaaaaagtagtgttttcaaaaaacacagccccttcacttaaatgatacgcacagtccagatagactgcaaaacttaatgtttagaagctaacaactttttaaaaactttattgatctgatctgtactgagaacagattttctctgtgctttataataaaacataaagatcaatcacaaaataatttatcaataaattttaaaacaaaaattttaaagtgtatgtaaatatcatataaaattaagaaaaaatatgtaagaataatatttgcaatgactatgataagcaaagggttaacaactgtatgaaaattttcatgcaaatacaaatatcccaacagagaaagacaaggaatgtaaataattcttaagtagataaatacaaatggatatttaacttaaaaaaaattttattcacattagtatgaaaagaaaatttaaataattgaaatctagtttttcacttatgaaattagcaaagatttaggaaaagaaactactgtcatttgctgctggtaagaccgtaaattggcccaaaacttttagaaagttattttacaatatttctcaagaactttaaatgtctcatatctgtcaatccagacagatagatggatggatggatggatggataaatatcagatggatggatggatggatggatggatttatcagtaatagatacatagatggatagatagatagatacatagacatctatagagatatatgtttctatataaatatatatctatattatcctaaagaaatatatatttgaacaaaatctatttatgaaaatgttcactaatgcaaaacttataatggcaaatagaaagggaatctgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtacttcccaataatcagattacatgtgattttattttcccccctaattttccttaattttcaagttccgtacaatgaacatgtgttattttcataagtataaaagacttttttataaaaagaaatatatagaactaattagccaaataggaaagtttctaagaacaagggaagaaatttgtgaatggagtggtgaagagatccttggactgagagctgggcaatgtggatactaacactggctctgtcacaaagaaacaaggagacttattgaggttctctcttctggctcaaagattttatgagccagtaatttatcaaagagcccatcctagtgtacccatgggcctgtcaaccctggtagacaggttagtagcccagatgaaatttcccgtggatgaattttagaactccgctccattgatcacccttttttgttgttgttgttcttttactcttctggaagagagctaagaaacttctgataccatccccctttcccactcgccctcagttgtgagatggaggcagcaaatattcagtgtgttctttttggtcttaagtagttctagactcagataccacctcagcaccaggctgagtttgggctggctttggctacggtttgctgctgaatgtatcagtgatggacttttgaatgtttaatagccttagggaatgtggcagtgtcccctacatagagaactgtagattctttagtccaccatttccaaccctgtgatttagattgtcattataagcatcacaggatgccctgagttgagaaaaatctgtgctgtttaaatggtctttaagcagcctttcctttctcctctttctcagctctattctgcttaggatatggcttatgccacttaatcaacatgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgcgaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctctttaatttactgtggttatattatatatgtgcaatggatccctattttcaaacatagtcgtttgataaagtgtgggctgcttttcatcacgaatgtaaaaagtctcttagttgctacacccagcaactaagtgtcctttaattcttaactttgaatacttaattggatccctggtgctatgtgtatttgatttttgttgtgaaagttgcattcactgtgtccctttatttgacatcagcaagatgtaatttctataaaccaattaatgatgcacctttcaactcttactatgagaatattagctggtgtaaatatcggactccttgtgaaggatgactcgctatctgattggtctttaaaaaaatactttaggaaataatggcttgcccctgcatataccaatttgaagtctttctaatatcagccattagctgggatccacatggagtacatagacaaatgaccatagtttctactgtaaaaatgcctcaagatcttgtaggtgagattaggcaattagataaatgcctatagcacaaaatgaattaacatgattgcttgaaaagaattaatttctgtaataatttgaagaaggaagaagttatgtatgctttggggggtatacagaaaggctttataaacaaccctatgaaaaaatggaccacagttttaaacgggcaatccacagaagggaaacactgcaatattcattggaaaaagaaaaggaaggaagggagtgaccaagagaagaaacaagaaggaaaggactgaaatcttgtttgcctttttggagaagatagcatttgaaatgggccttggataataaggtgtgattgtcgttggtggaaatgaattgcatccagaatgcagaaataactcaagcaaaggcatagagattggaaaacatggggcaggtagaaaacaagtccagagtctttgctgcttcttagaagatgtataagggttttattttatagttttataatgaagggcttttaatttcaagtgatgggtcagtgtataattccttaggagataaaattccagggaaaaggaggaggggttataagataaatctagaaatctaactcataaaaattagttcccttccagggagttagttactccaaaaatatccttgataagctaactctgcatggatataactgtgttatctgtgagctggctacagacaagaatttacaattgtctgtagttgcagtctttgagctgcagtcattcaatctctgtctactgctaaaagccagagtttggaaagagcccttatgcatgcttgataatgacacaatttgactgagaatactgccattttataataatctctgaaagttacttccttggtctactgaatctcatattttgtgaagttaaatgaccaatgactgtcattcattggccatgattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagattacttcatagtgaaacacttaagtttgattcttatgagttgcaaaatgattttccaccaggaaaaataaagaatatgggttccatcaaaagtcaggcatgaattctcatctcctgataaaatgtgaaatatctttgctgatcctgtgcctattctcagtttccatgaccatgcacaattattatttttagcaaataagcaaatttgaggcaaaaacattaatttgataagatatctgcaaatgcctttctggaggagaaaataaatttaaaaagcatcagtgtgtttcactgatatgcacaatcccccacttcttataagaaattaaaacactagtttttaatatcttcagagagaaaatgagtaaaggaagcacagtattttccgaaacgtgttatttaaactaaaaccatgaaatttatgaaaaaaaaaaaaagtagacccttccttgatacacttggtcccaccgaggttcaaagtttcctttgaattggggggggaagggagattctgtaatttaagttttaaacttctgtctttgtatctatccttgtgctggtactccgctatcttggttgctatggttttagagcaaatcttcatatcaggtggtctaagttctccaactttgttcctcttttccaaaattagttgaactattgtgcatcctttatatttccatatatattttagatgtggcttgtcaatttataccaataaaggattctgttgtacatgtaaaccaaattagggagaactgacactttaacaatattgtctttcaatgcatgaacatggtatatctctccctttacttcatttttttttttttggttctctcagcagtgtttttaattattattgtaaaggccttgcacatattatggaacaaacacatattatggaacaaataaatgtaaaagctaaatctataaaacttttccaagaaaagaaaagaattcttacaaccttagataggcaaatatttcttaaggagtatacaaaaaaccccacaaaccataaagttaaaaatgataaatttgattttataaaaactctaaaacttgttttttaaaagacaccataacaaatgaaatagcaagtcccatacagggagaaaatatgtgtacagtatgtgtatatgacaaagattttatgccagaatatagaaataattattaaaactcaagaagaagacaaagaatgcaatttaaaaacaggcaacagatttgaaaataggcaatagatttgaacaggtacttctctaagaaaatacacaaataaccaataagcaaatgaaaaatgctcaatatatgtagtcattaaagaaacaaaataaaactctgtaaggtacctccatacattgatgagagtggctaagactaacaataccaagcattagctaaaagacagagcaattgaaattctcatacactgcagttgaggatgtaacatggtactgccactttggaaaacagtttggtagtgtcttaaaaataaaacgtgttcaacatatgacccagcaattctcctccttgacattgacccaagtgaaatgaaaccttttttttacacaaaggcttgtacacaaatgttcatagcaactatatttataatggccaaaaactggaaacaacccaaatgttcattaacaggtgaaaggacaaattatgctatatttatacaatgaaagatgactcatcggtaataaataaatgatctgctaatatgcacaaatacatgaaaaaaatcttaaaaatatgatgctgaataaaaggaaccagagctacctccacccctaaaaaagactgcctaccttagaattatatatttacaaaatcctggaaaagacaaaactaatctatactgacacaaagcaatcagtggtttgctgaggctgggagtggggaaaggattgattataatggggactgacaaatagggaactttttggggtgatggaaatgttccagatcctggtaatggaggcagttacaaagtcttataaatgtattgaaattcatcaaagtgtacagttaaaatggttttatttattgcatttagattatacctcaacaaaggtggttttaataaataaacaagaaaaagtgtttttcaccaattggtttgaaattcggccaaggcatatttgagcgagggctgtcagccttgtatttgttgcaagtcacagtgagtatgtcctaatggatcctctacaaggtccaggttaggtttctttaaaggatggcaagaacctgaaacagtgtgagtgcagagaacagtgaaacagtgtgtgtacatagtgctttgatttttgtgcattttttggtcctaatattttaaagtttgctgaaccatacctcatagaacatttacctgctttttctgagggaaatatctttatagaacttttccaaagcattctgcatagattttattttaagaaattaaaacattttatttgtattaatttacataataattggttaactcacataattacaatgacaagatcatacagtaggagcagacttgggatcaaatgcagctgactctaatagcaggtgtagcaggaggcacacagctgaggggacatttgagacgaaattgaggccaggttccacttcacattgtactagggttaagcgtgtccacccagaggaagagaatccttaggcctaaaagagcaaaagtgtacagacatactcaagagtaagagagtagccaggaacaccagccaagccataaactccagtctgtgtgtgttaacagataaaattaagagggtaatctagggagtctattgctaaatgaagggcacattaagtctcaacagtattcctatgatcaatcaagcaaccaatgaagtgtacaagcagaagtgatttgtcatggaatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtggtaagaggccagttttcccatcctcatttactctaaatttgattcatagattattgagcctcagatatctgtttgccatctggtctggtcagtctggtttggcatgcgtcttctttctctttagagtttgatgacgttttaggctgtgaggggcatttgcattgtagtagaaattggatgatgtcagacttgctttatcacactttctcaataatctcttttggtgagtttgatattctacttacagctgctaaagctccttataaccatacgcacaaacatacacttccatatagtcatacatactcacaaacatatatacacagccatttacttacacacgtgtacacaaaggtgtatatccacacacttacatgcacaatgagagatgcatagtaagaatttttccactacccctagtttaactggaagctgtagaaaatctgaactttattatattgatctctgggatcatccacaaaattgcccaaaatgggaatgcggaagctgtttcttacctttcattttctccacatccaatgtgtcctcttcaactgtgtattttgaaacaacctttgaatctgtccccttcccgcaactgcactgccaactgctgatatcattttttgcaaacaagtgtaatgaaaagagcatattctttaacatcaagcaaactaaggtgcaaattttagctctgcatgtattcattgtgctatcttggacaagttatttaactatcctgagcctccttgtcttaatgtgcagatagaagaagataatgcctacctgataggtggcataggaaaaggtcaaaaacattattttctactcccattgctccccttgcctgaaacattataatggccaaacaactggcctcccaacctcctttcccctcttcagtttttcctctacattatagctagagattttgctaaaatgtatatatggtcatcccattttttacttgaaactggtatcttcctgcctataaaacacattttgtttcttagtctcacataggaaatcctttttagtctgtcttgggcccaggactccagtccgattttcctcccattcctacctgccctcttggttttgaatgttccacacaacttcattcctttctctgttaattggcttttcctttacttagaatgctttcccccttcctgctttttagggagaacagggtaaactgttctccctatccttcattgagtctcctttcttttttctaaagttttttcttatcagcatccctcccccaatttgagctcattttctagaaagaattaatagctttcttatatgactctcaagatatttctgtgtggttctctaacagccttcatttattttatatggtaattatagatgtccatttgttctagggaaggcaggtgtcaggtcttactcatctttatattcctggtttgacatacagtgcctgatgtctagtaagcacttgatatctgtttattttaatgtttatgccctacattatctatcacaagtattaaagattgataggtgctctgtaaatgttaaattgagttaattattttcaatcttacaggaagttacataagtcattcctgtattcatttgtgaattttcgacatcctatattaagagttgcacttagaatgtgagttccatgagggcaacagcacttctgtcttactgctctgtctgctatgttggcccataattaaccactcagtaagccttttgtgaaaacaacctcaatgagtcttctacctcaagtcttttgaataggaatggatttaaagctgacccctaatacatctttcaaactttaagtcagtaaattttttacaaacttttttaagttgataaatccctcagaaattattctgaggaagctgatgggatagaaatgaaacagactaaggggctccaggcaatcaccactccccttcgttctccttcctctgttggtggggatcaatagagcaggatcctcaaaactgtggagttctttggagcatactttgaaagcctctaattctattccacgctctaatttccaaaagagggaactgaggcccgtggtggttaaatgccctttccgaggttacacagctatacatggtagagccgacccatgtcttctgactctcatcccgttgcacttacaactagcctgcatgttccccttttcccatatcgcatggatagcatcttacgcatctaagtttttttctttaataatgatcttctcttttctttaagagacaccatcactccgagttgtaccacttgcaccaggctaaattattcctcagtgtttacccctttcagatatttatagaccatcattatggcactccctagtcacctgtcagcttcctaatatgtacatatatggtttctttaatctttctgtacagtcggcttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgtaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttactgagcgtatccatttttatgcagtttctgtggacttacatggtttctgggagctccctataagccttagtaagggaaagctcttgacttatctcactagttattagggatttggatatatgtttactaaatgtgataatctaagtatggaaactacattagtacaagaggaatcacccagaaatactctactggcataaataaaacattacctattgcccagttttctcatttgtttcattttgtaacttttataatgtgtcaataagtttgaagtcttgaagggctgcccagaaaccaccacagagtggattttccttaccctcaatctgccttcatcaaaatttagtttgtgtgtttatcctataaaatttatctcataataaaaactgaagactaggacggtccttagaaaaacacttgattcggtgtatttattttataaaagggagtcacagagagaaaatgtggccagctcaggtacatggcttcctaggcaatgttccatttcgcaaaactttcattggtccagaaagtgtaccttcattcccaaccaaatccttcctataatgctttccatgcctttcttctgtggctctctctgatgatctcacaggtctataagctcttacaggtagaaatatgatttcttgctgtgttcttattataaagcattgccatgcaactgagaagtaatgagagccagtggattttattagaatggaattttaacttttctactttaaaacccagtgattctgctagtctggaggtagcaaagaaggatgactattttctctctcacacaaagtaagattctgaaggggcttattctctgaatgaaaaacgagaggagaaaagtaagaaccttctaatgttttattcaaatgttaacaaagaaatttgagaagcatgtttccttaaaattgacaccatttttatcccaaacattctggtaagtgatagcagatgactgtgcaagcttctatggagagagagagaggaatttttccaggagcatagtcccagtgggaagtattacctaaaagtaatacactaatcactttcaatcttgcatatttccacatactgtgtgcacacatatgtgtattaataactgttccctagacgtcacttcagcgctcagacagcttagtgttgctatgcgaatgctggagatggaatcagatgcagactacagtttagcaatgagaattcttcagagatacaagaatggaaatggccttaggtcctgcctcatgggtctccctctgagctccagtgtaacatcgggtgtcaagtatttgtggccccatctgcccactccactgagaatctaaatggcattgccagtatttgtgaggtactcatatcttaaaagtcagtgtactcaaatcagtcttgcattctaccttgtggattttgcatggaaattttttagaatgtcattgctgatggaagccccagatatataagtacatctgctccatcgtactggtgatttttatagatattcataagaaaatttattttacagcagtttattttagaggaattctttgcattttatttgtatgtgtgtatacttattttactggcaggatacacacacatgtatatacacacacacacatacatatatacacatacatacatatatatatgaatgtatgtttgtatcctgtcagtaatactttgaggtacctagggctgagattactatttctcttccacctatggctcaaatgggtaaaatagcttactcaaagtcacagttcatacatgtggtgcagcttgaatcaaaactcaattcttctatccacagatttaccactacttgagtagtctgtggtgtttaaaaaaaataataaacaacaggccgggcacagcggctcacacctgtaatcccagcactttgggaggctgaggcaggtggatcacaaggtcaggagtttgagatcagcctggctaacatagtgaaaccccgtttctactaaaaatacaaaaaattagctgggcatggtgacgtgcgcctgtaatcccagctactcgggaggctgaggcaggagaatcacttgaacccgggaggcagaggttgctgtgagccaagattgtgccgttgcactccagcttgggcaacaagagcaaaactctgtctcaaagtaataataataataagacgaagaagtaacaaagccaaactggaaagtttctgttaaatgaatgttctagataataccaacgtataaagcaatcattttataccagctatggtcaaacagggaccagagccttgacttttttttgcctcaacacagctctgcagaacccactcagtaccccatgtcctactgccattcctttggtttccagaacattgagatgtacaaatccaaaacaccacagtgtttcagagagaaatggcatgactctactggttgcaattgtaatggagttcaccttgttctggagtcatacagaagccatgttgtagacttagtgtcccacgcaatactcctaattacaatgaaaatctactgttaggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttatagagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatggcctgatcaacactttttaataaaatcacaatatctactgctgaattttggagggaaccaattcaaatcatagcacacatcttttctaaaatggaaagggtaatatgatcattggagaaatactcattcctttgcatattggtttactatccaagccaggtgtggtggttcacacttgtaattccagcactttgggaggccgagatgggtggatcacctgatgtcaggagtttgagactagcctggccaacatggtgaaaccccatctctactacaaatatcaaaaaattagccagccatggtggcacacacctgtaatcccagctactcaggaggctggggccagagaattgcttgaacctgggaggcagaggttgcagtgagccaagatcgcaccactgcactccaacctgggcaaccgagtgagactccatctcaaaaaataaaaaaaaaagtttactatccagagaatcttgtccaggttaacactcttttttgtctgctttcttcttttgtgaaacaagaaggtaagagggacactggagaaaacctaatgttctttacaaaatgagtcatagttctccatctgcaaactgtggctcccatttatgtcttggtgtcaatatgactattacatgttatgtacatggattccacctcatttgcaacatagtcttctgcctgagctctgtttgttggatctgatctaactttacatggtcttaagtcacacattgaactcttaagttctgtaggcctctaagcctttttaagttttagtattttcatcgttaaaatgagagtgattataacccttgctttgctgcctccaaatattattgagggatcaaatgcattgataaataagataaagcactagacaaatataagggatgcttgatgacttcacagagggaagattattctgttgctggctgctgaaatacagtagctttagaaaaacccctttgggttcccttattatcaggtttggtctcaaataaccagaataaatttggagatttcctaccacaaaagctaaaagtacctgggcagatttaccctttgagtggacctaagggaaatgcagattcccacgggagagatcacggagcagattcaaaccataaggcaaaaataattgttgcaatagcggttctaactgtactagtaaatattgatttttctgttagcagatcaatcatgaaatgaattctaaatatagaagactggttaaaaaattaagacggagaatgtgaaaatgtccatgtgtaaaaattaacttaaagagaaatcttgctttggccaaaagaaatactactgtttctgtcaggaatgttctgtgatttaatcaagtttcctgcctggccagataattttaggaattgtggacttttaaagtagtaagtcagtttagaaaactggttaagtggacagatgtaaagtcagactgcctaagccccaattccagcttcaatatttaactctgtggttgtgggcaaggcacataatctctttatgctgccttttcatcaactgttatggagataatgatagaacctacatcatagagttgttggggtgactacatgagataatacaattaaatacttaacacctggtccataaaaagcgctgaataaatattgactattatcatcaccccggggtctacaaatttttgtaggattaggattaggattgaaatttctaccgaaaaattccatcagtaaaatattgataaatataaatcttaaccaactgcctcagagacatagggacctctattttccactcattgactgtcatctttagagaacagtccaaagcatgtgcctttctgttctagttgttatgagctctttattttgaagttgaactatatacttcctatagtttaaaggagaaagaagtaggtctcatgctggacaccttctagatgttacctcctccgaatttcatagccaagtatttaaggcagttatgatcatctccctcttagagaagcctagaaaaggttactgcagtgcttgacagcaaatagaaactcaccaagtgcatttgttgagggattgacagaatggctggataagtgactcaactaagaccacttatctagtgagtgcgtctactcagctgcttgttttgaagacaaggaaattcgggctcagaaaatttaggaaacttgtctaggctgccaatagctagtaacaaaggcaagaattgcatatctgattttctttacaccatgttacatctaactgttcaaaagataaccatgtattatactcgaaaatgcaaaacagggttgttttttgttttgtttgttgtggtggtggtgatggtatttttgttttgtttttgctacttttcctgagagtggaagttgttatcaaaaagttactgtcatgactactatgtgtatagatgctattagtttcatcaaggttgggaatagggtatatgttgcccaactttctgcccctctccgcctcatattaaagttccagtttcctagaatatatctcctgggagatttggcactagccatcactgcattccaataccccgggacaaactactcttggtggaacacagaagcatacagtccttgttacagcagtggttctcaaactcacattcctgatggaaagctagagttgaagggtcaacacccaagagctgcagtggaggaccatcacctgtcctgattcgccacctgtggtagatcatgactttcactaagatcccctgaggcttgtggggatggagaagtgatgctggactggcccttcctctttccctgcaggtgttaatgggttctgctcctaaacaatactgatataggtcagagttatgattgaattgtatacatagaaacatgtgctgattgagaaaatgggctttacaagtcagacctggttccagtctcagccacactacattctgcctttgagactttggccaggtgatggaacatcaggtttcttatctaaaaaggagaataattggttggtaggactaaatgaaaaaatgtatgtgaaatgcttaggacagtgctgagcacagataaaaatgcacaataattttctattttttgttagtttccttcacaatacatatatttacatcagcgaaacatgcttgcttttgcaaccttctgtgggactccccctcctaatttaccacctcacctgaaggtctaagctaagcaaatctctgtctataaatgaatcacatcgtggttagactttataacaacttccccttgccaggagatcactcagccttcacttcatctcatctggtttgctgcccaggcctttatccactcattcctgaactcctctccctgacaaccttggggttttggcttgttgtgtgcgtgtgtgtgtgtgtgtgtgtgtgtgtgtgtgtgtgttttgttttttgtttttttttactttaccttaatttctctttttggactaagatgttaaaatgtttcttaatgtgactgtctccgaaactgttttgtgtctaccactcatcctagtggcagtcattgatccttttcttgttgcgagtgtttgagtgtgggtgtgtgtgagtgtgtatatgtatttgtagagggaaaaacaagagagagggaaacagacattggagccacctttcccccactagccacgtacctgttgaaccttcaagcctctctatagaatcagatatacacaagcacagtgacagaactacatgtgtcctacagtccagcttttaagatatgataaaaactcttgtattcacagagctaaatggcaataaccataggagattgcatattgctacattatgtaaagacagagtcccaagaaaatagtgagaactcagtttgatgtatgatgtgatatgtgatatcttactttacatggctaacagttgacattctttgtggattctatattgtctaaggctacagaagagccatatgataaattcatcggcaacccaaaagaagcctgttctatcgcagtgcttccaattaatataagtaaaccactttctctggctcaatgctaccaaaatattttatgagaaaatttagctgattctgctcatgtatattttcaatggatggaaagccattgcaaacttttcaaactaaaatataaagatagcattagggagaatactctctctggtgaaaaacaacatgtattatgatgcgttaggaatttctttttttcagccaactcgtggttgagcagtctgtccccaaactgttttgcatgcggacgaaacctgtttgggcgatacttgtcagcttttcttctgacaagcaggacagaaataggcacccccagaacactgagtttgacttgactcaacatagaatcacctggagagttttaaaagtttctctcctgtaatatcccacctccagaccaatgaaatcagaatctttggagttgggaaccagggatcaatatttttttttttaagtttcccagatgattgcaatatacaggcaagattgagagtcactgtcctagagtataagcagtttaagaaacaagttgtctattattacatgcatcaatactacagagtccatgaaataaaagctttggtgataagaaaatgccaccatcctagagccttcagttaacatcatatgggcctgtcatataaagaatgcaaactcattctgttatctttttgggccttcagtggaagataatttttaaatcagcttaatggaaactgtgcttcaggaaaataacttcagtagccatatgtaggataaactggagcaggttttgtttctaggaatatgttgccatcatttcactacccttatataatcttattgattcaacttttagaaccaagactttttgcagaatatatcgaagaatgtgcttaatgggaatgctgatatatcatacaattggcatatagagcttcagttcattatcatatttaaaggtacaatattaattttgcttgtgcttaaaatgtctattataattcaagtagcaaggaagacataaagaaaaatgtgacctggctttacatctgcacatatttaatactttacatttgatggtgaataatgggaaagtttgggagtatgtcatgctcagtcaccatgcatcaactcccaaaatggctgtggacagctttggtcctgcctcaaaacaagcactgcttgcaaaagagggtctgtggcttatttttatcagttgtgtggtgatcacaggaaaaacattttaaataaaaagtttattttgccatcatgaaagaaacaaattcatattaccaaaagagaaaataaatatgacaacccagcctggtgcagtggttcatgactataatcccggcacctcaggaggccaaggttggagggttgcatgatcccaggagcttgagaccagcctgggaagcacagcaagaccctatctgtacaggaaaatattaaaaattagctgggcttggtggcgtgtgcctatagtcccagctactggtggcaagggctgagggaggaggatcacttgagcccaggagttcaagggtgtagtgaaccatgatcgcactactgccctccagcctgggcaacagagtgagatcctgtcacaaaaaaaaaaaaaaaaaaaaaaaaaaaaaaaaaaaaaaaaaaaaaaaaaaaaaaaacaaagaaaagaaaacccatatcacgctatgccacttctcttgttcaacctgtagatttccctggaatgccactattcacccatgccatccccaaaaatgacttgttaaaattctaactcttcagattagctccattattaagacttctgtaaagtctttctgttggtaagaggaggtaaatcagagatatcagaacaatcaggaagccattgcaatagcctttgaaaggaagggtgattaggtagtaggcatgtggtggaaagcaggcatttctgacacattgctgaggttgctatagatgggagagcagaggtgaaggataagaagaattgttggctgaatctagagtcagtacaaagcaatatataaaataagtaataatatataaacaccatttttggttttgtttggaaatcttaattcactgacaaagttccccatcggctgccggccctctgtcatcggatcttttgattgactgactgctcagcattggcagcaagctcttcacaccagccctgggtctgagctaatcagctgtgtttccttcatgctctgatgccttgaagtttggtactattctcctggtttctcttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctagaggaatattctccaaagcataaagtagaagatcattccttaggaatacaatacagtccatctgttttcatagctgagaaggcaattccgtgtcatgccatcatggagccactgcagtgttttggtatccaagccatagtcactcattctctccgtgagggaaaactagaatgtcttttcctcttccacctttacctttcaaaattccatccttgaaggttcggctcaaatgcttctttctccacacaacctttcctgagcccctgtgagtgtggttttccttccacattccatagcactttcttctaagacgtgttacatgctttgccatgtgactattgcatgtaggttgtcttgactgtgagaggcactgacatcgtgacatcgtcgaattcatttttgtatatcacacagaaggagaacatagtcgtgggcaagagtagatatttgaggttgaatagatggaccatttcaaagcttatcttttcagcctgacctttaaggctttgctctggccgttccctctaaatcagtgattgaagtttgctcccagatcctcatgagtagctatcaaactctccataagccatgtaggctcaggttcttggattccaggtattacacttcgggcatcatagtctgaatcaaaattgctacttttagctgcttagtagactgccattaccaatagtttaatgagaactacttttttaggggacggggggaagtgtggtccacagatccctgatagcccttcgtgtactatgtagtgaatctgcttgacatctagaaaagggaagagtaatatagaaaaagaattttgttgacctgcctgcatttaacaaatgtaaaatgtaaaattacagctttcacaggaatctaatatgcttttaataatcatatggattggtaatccatttactcctaatccctaattcgttttctgcaatgaaatgttgtcaaagggtggcatgaagctgttagaatttaagcatgattttcaaacatagcacattttttttgtggttttgtttttttggttttttttttttttttttttcagaataatttcaaaaatagtgccatatgaaatagttttgttactgttggcaggaaagtccaaaatgttatctcataataaaaacaggtacaagttcagtcttggataaaaacttttgaagtctgccacaaacaaatactatacaaaattttttcatcaaatgtcaagactgtggtatcaagactttataatgatatcaactgtagtggtgacagcttagtttccaatactttaactctttttccagcacttcatatttctttttggtttgagatgaagtctcgctctgtcacccagctggagtgcagtggcgccatctcagctcactgcaacctctgcctcccgggttcaagcgattctcctgcctcagcctcctgagtagctgtggttacaggcacacaccaccacgcccagctattttttgtatttttcatagagatggggtttcaccatgttgaccaggctggtcttgaactcctgacctcaggtgatccacccacctcggcctcccaaagtgctgggattgaagacatgagccactgcacccagccttcatatttcttattccttaggaaaaaaactaagatgtatactttgggttatatttaaagtcacattcaaatcccacaacaggatataaagaaatacttttcagggccaaatacaactggagaggattagaaataaatttacctttttttctctcacgttgaaacatctagccctcccatgtttgagtgtgaaatggctgtcaatccaatgtgatggagtgctgaaagccgtcttcagtgagaagtctctccataatgctccctaacatcagatccatgttaatcctgatgcacagaactgggaataggtaatatagcatagtgtttaagagcacagatgctgaagttagactgcttaggctggaatttagttaaccatttgtgtgactcagtttcctcatctgtgaaataggcataataacagtacctgcatatagactgttgtgaatatgaaatgagttaatatatctaaagcccctagaaaaagtctgacatatgtgaagcactacatttgctataccttatctatcaaagcctacagcttctggctaacattcccagtgttctataattattagatagaattttttttaacttagtagaaacaaagactaagaagggaaactagatgtggacgtgacgtctagctcaagattcccatgatggagccacatagagatatggatggcaaccagcataatgcctctcactgacataactatttgtctgaatttatattttattgttattatttaaagcttactgcaaattttaaaaactgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggtaagcagttagaatgaggaagcactatggctcagtaggagaaagaaccttttagccatcaaagcgatctagaaattaaaggactgccttgggatctgcctgtcactgagagctggctgcagaggttttacaatcagggcttttgtaaaaggaactaaaatttgagtttggacccaattatcttacattctaactggatgtgtagaatctccaagaagaaagactcttctgtactgttttatagattttgccttccactccaaacatcctgagtcatgttccttttatacttgcatgtgagatgagagtcagagcactgacctcaaagccagcgaccgggttctactgttcctttctgcaagaacttagactatgagactcaatcccctcaaccgattaatgtaaaatcccctccatgccaatcttgcagaggataggggtggctgtactggtgatcttgctggggtaatggggtaatagtactggggtaatgacggcaggagtggtggttctattgctgctgacgttatgaacctgctttctcctccactttggctttagcaggactgaagtactccttggtgtgttcttatcaaacccttttttttccaggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattgtaagttccagatttgttcctcaagcactttgcaaagatgtcttctgtggctgaatgccagtcactctagatagaatatagccatcagatctttgcttcttcctagacttcaaaatgtgtgtgtggggtgtgtgtgtgtgtgtgtgtgtgtgtgcgtgcgcgcatgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttacatgtgcagtgaaattcactgggctttaggaaattattataacctttcagacatactcctcgcatttttacatgtttgcttgcttttctgagtgcgtaacaaaactggagaaggtctaatctgattaaataataggtttctacagtgtgtgggctcaagtttctatctccattccaggcatagtatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactatgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgttcatatagttttgcattgttagtattcatttttagatttttatctgtttagttttacatttagattacacacttcattttaaaaccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagcacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatataagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagttttagaaaaagaattgctgttttattcctagcattaccaaggagtctgggcctagggacagagtgcatcagaaattctcagcaaaagtctatttatgaagtggcagccaaggatcctcccccaaaccagtgcttttattcccagtggatggactccaggtcctaactctctgacagcagaaggtggtacagacatttttactagagttgaaatccaaatgactaaagggcctctggaaataggaggccaactccacaggaggctaaacactttaaggtacctgaaacttggcgcattagtgaccaacacactagcagccttttgctcccttatgtcatcaaatggctacagttaaaacattctaacttgtcagcctacattaagaggtagttttgtacctctgcaggaaagctgttcttttatatactcaattcttcttaataaaatgttttaaaagcacttatggccagtgctttatgtggatgttggaaaaggaagcaagagtttggactaaacctgaaaaatccacatgaactttcttcctttttttctaattgcctacgtctgctctctcacctccaaggagtgtttgtctgtgcctcttgtctctctttctgtctcacacaacacacacacacacacacacacacacacacacacacacacactttcttcttgctgttacatcatcatttcaccagaactctcctaggaaggagaaaaatggttcaagaaagagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacacccagcccatgttaaattttctacgtgaagatcctaaaagcccccaactactcagatttaaaatcaggtataattatagccttttcccagaaaattttaattgataaccacctgactcatgctttccagtatcacagaacctgaaatgctaaacttctactgatgaaaaaccataagcccttgtattttcttgagcatttgaggccttaaaaagcaaaaaaaaaaggttaaaaatatttataacaactgacattgacattaacatttgctcagtgctttaacttttatgaagcacttttcttttatcatattaccctctaattaatgatcctagaaaatagttacagttatttttgccttcatttccagtggcaagaaactgaatcttagaaagtgtcagcttgcttagttccatagagtatgagtgtcagagctaatacttgaccctgggcctctgattcccaaggccggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttgtcatgcacttcttttctgttatgtttacctgtgggtatggaaggatgtatacaaatgtaaccacacatctgtatacatgtggttacatacacacacacacaatgagatcataccttaactattggttagtaccttgcttttgttacataacagtatatcaaactttgccttctatacagtccgttttaaatattcttgaaccactgaaaaagaatatatgtcacctacatatgctttctgaaggttgattcaaggatattttccaaaaggcaaataaagtaatcaaaataatatgcacaagagatgcatagcaaataaaatggtgaaaagcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaaccttaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatagcaatgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagagcctagcaaaaaacgagatgcttaccaaatcattttataaagctagcgtgctcccaataataatacctaacctaggttacccccagaagacaattctgtgataatctaactttcataaatgcagaaatcctaagtgaaatattagcaaattgaataccacataataaaacattccagttattccatattcagtgctagaacaattaggaatcttttagcataatttgctatattgatatatcaaaattttagaaaaactagtaatctccatagatgcttttcattaaaagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcactttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgccctagtttgtttaagtcaagcatgaactcaccactcaatgtttgccagagtttggatgaatgtcagcatcaggctactgtaataatggtttaagattatttaatcccattagttatacacttcattaggctgagtgaattgttggcagtggttcagtaaacttcctcctttagagataaaaggacagaaagaaaataggaaaggagcctattcctcattttctttcatagttataattcttttttttttttttttttttttttttccgagacggggtcttgctctgtcacccaggctggagtgcagtggtgcaatctcggctcaccgcaagctccacctgccgggttcacgccattctcctgcctcagcctcccgagtagttgggactacaagcacccgccaccacgcccagctatttttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatattagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttacttttagcttcagtttcctcacacttagaatgaaaacaaacaataagagcaaaccagtttgttatatgttctcacatctgactttgtaaaacagtttgaaaacattagcgtgctcagctccaggattgtcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaaaagaaagaaagaaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttccgatctccagccttaaaatgctttcctggaacttaaccaactagatgtaaccatttctgaacatgcaaggttttcatttccacatctctcataggattgatcctcaccacaactggtattatcaagtcactggcatccttgacacactccagtactgacaggaaccccttgaagactgtgcggggtgcggggaggtcacccttttttcttttcttttcttttcttttttttgagacagagtctcactctgtagcccaggctggagtgcagtggcgccatcttggctcactgcaacctctgcctcctgggttcgcgccattctcctgcctcggcctcccgagtagctgggactacaggtgcccgccaccaagcccagctaatttttgtatttttagtagagacggggtttcaccgtgttagccaggatgatctcgatctcctgactgcagggaggtcacctttaattcgtctttgtcttttctgtagtgcttatcataataggtgaacctattgctgctctgatagtgagggggatttggggggagcctgtgtcactctagcactatgtctccccacagtcattgactcacataccctttgcttgccccttcgtgcacctaggacctgagactatgtatgtataagaaggaaggaggagaacttggctctgagagactatgaacagagtcattgctgaaatgtaaatatcaaagattgaagggaaagatgtgagagtgaagccagctgtctagcttccagccgtagaatgatcataagagctactacactcaaggtcaaacacactgactcacccatgaaaattgccaaggagtttgagtggaagttctctgatattccaatgactttgaatgggacacggtaattccttcccacagccagggcttacttaaaataagtaaatgaataaataaagtctactccctggatcttttttttgctcttgtccctgcagagtaaggggatgccagccaaggctgacatcatcattatagcaagacaggtgctttttttgaatacttcacaaggacaagggcctggtattatgtaggtcttcaaagaatatatatatatataaatttttttaattcagtctcctacatttatagtatggggaaataagacaagagcgaggaatgccttgcttgggatattgcaattggatggctgcactgaggactatttaagcaaccttaaaatcacaaacacacatctgtgatgactttttaattatatctgtcattttggaaaagatattaaacatcttcctcagaagttatttttactttacacactctttaataatgttaaaagatatttgatgcaatttatattaataaagctcatgggacgtgttagtaaaaataaaattgaatcttctaaaatatattcctttaaaaatgaatgtctataattttatgctagtttaagcaaataatctgaataaatcctgtttgtttagcataacacatgtacacgtagtttctccacaaaatggaacgcgctaaatgtgttggggcctcaggaaagaactagtggaagggggcataggaggatttgggggcaaaaggaggaatccaaaaagaaggtcttcatggaggaagagacctgtcccaatgtgtcattcggtagatctcactttctcctagtacctcatagtcattcatttttcacccccaacagacaagtggagactgatattattcccttttacaatgtaacaaaatcaaagcttagaaaaccagggggtttggaaaataaggaatttgtgtaggattaaaatagaactttgagctcctggactctgaatcttagcttctaccttgcacttaaataaatttatgctaacagatgtcctgtcatcagataggacttttttttttctttttaatgtcggcaagtctcattgttacagctctctggtctgcccagtttggttacacctgttttgagattccttgcctatacccttccaactgaagacaagcacttcctactgtacttacagaactttcatctatgtcttggtttaatcttttgcctttgttttaaccgtttaccacttctgctttatattggtaggtaatcttacccccaaatacatagactatgagctccttaggagcaaactcattttttttttcctgttgttctttgtgtctttttttccctatccacctccaaatcttactccacatttctgaaaatagcacccaaagcaatacctctcactttggggagtatttagtacattttttaaaaaatgaatgtattatacagtctggatcaccataacaaaaatacaaggactgagtgccttaaataacagagatttattttcttatagattgagaatggaagtccgagatcagggtgttagcactgtaggattctgctgaggactgtcttcctgacttgtagatagccaccctctcactgtgtccttacatggtgtgtgtggggagggagcaagcccactaagtgtcttttcttataaggtcactagtaccatcatgagggctccatccttatgacctcatctaggcttaatcacttctcaaaggccccatatacacatactatcactttggggttaaggcttcaacatataaatttataaagggactcaatttagtccatagcaataaattaggccttttgactatagatctgtaagtgcataattggcactgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgatccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggcacaagtggcaggaagccaaactgacctgagtctggctgggcagtgtctgcaggttactccagcaaagctgctggaataacgatgtgttcttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaataacgactcccaattccctgagttaccattagatggtattaagcaacttcacttaattatgtacctgttttccagttatgttaattatacatcctttagcatttaccacctgtaccaatcatttagcataataataccttatacttaaatgcaagtacccagaatacttttatagttgttttcatttgatattcacaacaatcctacaaggcaagtgttatttctagattagatatgagagaactgaggcatagagaaggtaacccatatagccaagaaactaaaacagggttctgacatccattttctaactatgcatctaggtttttttttttttttacctctgcgtctaagttgcctgcctaaatcgccttcagtccattgaaatccatccaatcaatatttactgaacatcatctgtatttcaaatattgtagtgggcattgggggtatgaaattgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttgatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaaaaaaaagatgtccttgaaaaactaaggaatgttagtgcacttatagaaattcttgcagtttggagtaatttgccacctccccttctgaaaaagtacctgatgatagtgtgcttgagagataggggtattgcagacatattccttaggtgagtaaaactgaattgtaaagtggatgctatggaccatggattatttcatttagtacgattgacagtagaaaatcaggaagggacgtgcatcagtgcgaggctgacacacagatctgaggatggcagaagctcactgaatagcacacgcaaggacccttcaaactcatcacatgtgccgtttggttccctttcaatgggtcggtcttggaatatggaggtctgctttcattttgtgccaagtaaccacgtgagcagtttacaaaagatacaaacagaaggctgctcattcatttttcaaaaagacttttttttttttgcaatggagtttgcaaagtgattttgcaatggattttgcaaaaaaaatggatgccattttttttaaataagtgtaattccaatgatgggaaatttactagctctcaaggcagcttttccttgtgttgaaatctctaaaggttaaaaagttactttttggaaagaagtctatttccttacaacatgttttcattggtccatagagaagacagctaatacatcttccacttggcagccttttaagtatttgaagaaaattctcaagtccatctgaatcttctgttttggctaacttctagttccttcatccatttccaacctaaatttgagcctaacgaacagatttcttctttcttatttaaatatatatatatatgaggaaataaaggcacagagggcttaagggagttgcccaagaacatagagctggttggatgactggaatgtaaggctgtgtggctctaaaccttgtcatttagactagaacacctatacgtcagttagcttcctgccacttcttgttttctgcctggataggactttataaagagtttggaagaagggagagttccgacgaggtacagaaatcagaacttccccttcttccaaactatatacaaataatcagttaatcagattaaaggactcttagtaacattgaaatcaaacctttgtgtttccaggagctctgagaacaacaatttttttggagcattgcaatctcttgagtatccaaaatgattctgtaatgatgtctgtgaggtcagaattggagcagcaaatggaattcctttaagggcttcccatcaatggacagctgattccagaaatggaggaggcacagtttgtatccaaattcataagcacaagtgggagaaattaggctttggtaaagagggtgacattcccaaaggaatcatctgtgaagttggggaaggaattcaagctcagggctgctgttctctaccaggttcttcagccagctggacatgctccccaggtttctactcagtctggaatgttagtaaaagtccacttcctctccttgtttctcccttctagtgaaaacgttcctcttctctaccttcctgacctcaagaccattgttccacacatcccccctcaggatcccaccccgccattctcattctcattacattgtttctggatccatgtctttatcagatgcagcccactgtccctttcagaagatgccagaaaatttacatatgtgatcaaatgttcccatcacaacagttctttccagtaatcccagtgctgggcagctgattccagtaatggaggagacactttcagctattaggcaatggatcacactttcaaaggagattgagcaatctcctcatcaagttgtacttagagcacaaatctggtgccaaaaggcactaccggattcagactgacagcactgagagttttgagtgaaagggaagttagactggtgttatgtgtattcactgggaggaactcaccgggagaaataaagagggtttccagtttattcattgtgtaaagcggctataatagtatttataggggttttgtgaatgtcaaataaaattatatttggaacagtggctagtgccataagtaggacttaacctttagcaatatgtactacattaaaaggaaggtggacacatgagtgatctctagcattttgtgactggaaggaaagagactggatgaccactcttcagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaaaaaaaaaaaaaaaaatctatcaccccccttgattcacttacctcccactgtgtcccttctacttcacgtggggattatgggaactacaattcaagatgagatttgggtggggacacagccaaaccatatcacacatgaaacacagaaaaaggacatctttttacatggatcttctgatatgcttgtaccaaagcccacagtatatcctgtcttcttgaaagagtatcatagttattcatttgccttggatggaaataatgttgtaataccagttaatacttttttcaactaaagggaatttggcttcatctccagttgcaaattcacatcaggaaatatcaaatccaaagatcaaaactcagtatctcatcactttcaggaccatccttgccacttgtctcaggcatcatgtacctggaagctgaaaagcaatgtacagaacctttgaattggagagatatcaatttgaacccagatcctgctacttcctacattgtgaaagggatcaagtttctttagttctctaaagcaaaggtttttcatctataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattggtctccatgtatctctggtccctttttcccctgtcttctgagtgccctggctccatggatcatccattctttatcctacccaatgggattcttctcgtcaacatccatttgtgccccagcttggcccatattttccctccattgactccacagctctctgtagctattgctttatcccttccttcacagccaaactctggaaagttggatattagaaatgctgtctccacactattcacaatagcaaagacatggaatcaacttaaatgcccatcagcgacagactggataaagaaaatgtggtacatataccccacagaatactaagcagccataaaaaagaatgagatcatgtattttgcaggaacatggatggagctagaggccattatccttagcaaagtaatgcaggaatagaaaaactaatgctgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctgctaccaggcccctatcccttcatagactagctgaggacatcagggacttccatgttgccaaaaccgtgagtctaatcagtgtttacctaacttgatatctcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaatcttttatccctcgtcccccttccacgcttccccccaaatccccaaagtccgtcgtatcattcttatgcttttgcgtcctcgtggcttagctcccacatatcagtgagaaaatatgatatttggttttccattcctgagttacttcacttagaataataatttccaatttcatccaggtcactgtgaatgccattatttcattcatttttatggctgaatagtattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatattccatcatatatatatattccatcatatatatatattccatcatatatatatattccatcatatatatatattccatcatatatatattccatcatatatatatattccatcatatatatatattccatcatatatatatatttccatcatatatatattccatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatcatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattccatcatatatatattccatcatatatatatattccatcatatatatatattccatcatatatatatattccatcatatatatatattccatcatatatatatattccatcatatatatatattccatcatatatatatattccatcatatatatattccatcatatatatatattccatcatatatatatattccatcatatatatatattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctcaaaaaaaaaaaaaaaaaaaaaaaaaaaaaccaaccatcagtgcagaagaggatgtggagtggagagactgcatcaattatattttgctgatgagaatataagatggaacaaccattctagagaaagttttgggaatttcttcttttaaaactaatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgttgggggaaactggataaagggtacttagatctctacgttatttctttcaacttcatatgaatctacaattataagaaaatttaaagtttaatttatagaaaaggcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagcatttaaagatgttgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaaggtgttcccttttaaacctgctcctctctgtgttccttttccatgaatggcattaccttgttgctccaaccaaaggcacaggagctggcctgtatccttcctcttccttcagtatcccctcttatccacttattaaccaatttctgacataatactttggcttcctttatatcttctttcatttatgagacaagttccttcagtgttttctagtgacttttcattacttggaagagacagttcatactcctcacactaccatgtaaagagctcatagccacatgcacacacatgcacatccacttgtgcacacatacctaaacacacacccaaaacagagagattgtctcatgcctgtggctgggtaaacacttgtccttgatggaatgtgtagctttcccatctccatcccaatcacctagccaaaaactctcctccttcaggcctccatttagacatcacttttccctcaagtatgtgtgattcttgtgccttatcctccccatcatcctgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgagtaagtgtttcttgactctggggctgtactgagttgaagaaggatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccatccttcaggtctcagctgatttttcacttcttccatggagccccctctgacttcacaagattgcgttgtcctgctcatatgtcctgctcagagcatgctgcatgtctcacttcatagcacctgttatttttttagtatagattttggttttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacaacttaacgcccttcaagattttgtgtaacagggaaaggagagaacacctggaatggttcccgcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgcagtgcagttcagtgcaaaccaacggaaagcccacagtttttttgtttttttggttttttttctaggtgtaaacaaacctggttgattgtgaggcaaagaaaaataacaaaaacaagtgagaatacattagattaatttactctttcttttttcccgctcattcataatgtgattgaaatcagaagtaaagaaagtaaaatcagagtgagttccctctgctcagtcacccaccctgatcacaagacttttggaatactgggaggcactgcatttaagtaagtatcagctgtatggagagtatgaggttaagatgatgctggatttaatttaaagtctcctcactggtttgcgtgaaggaagatttttatcaagcagagtgaaagagacagaatcttgaagcttccgcagaggggaagaagacagggccgtgcactgcgagtcagtatgcctccagtccctctggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatccttttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgctagggccagtattgtaggtggcaaccaggtacattagtctctgcccttgtggaactcatattcccatgtttgtaaaggagtctgggcctcttatatgtggtaaatgaagtgactgtctatgtagttgcctttgcaggacacaagtccttgccttagtttccctccagccaggactgccccaccgagactattcatagctccaacttaaggtgctttaataaagggcagaaatcatgacaagaaaggacgcttttcttcaggcaatgaattcagcctgattttagaagctgttttggagaggtctctgtaagcatattacattttattccctgcagtacaatatttatacatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactactctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaaaacagtgttccttctacaaatattctattggctggggctcattcactttcacacagtaacaaagaatgcttggaaatgtggccacactgtatacccccaaaagaagaggaattagtttggttcaaatttatctagtctctgtcatgctttcatcatcatcatcatcatcgtcatcatcatcgtcatcagctactgtggatcagcatactttcctgcaattttccaaatcgaattttgtggttatatattaacagagtatataaaattcattttccctacataatatgtattttattcctatatgtgttttctgcagtggtctgatttatatcaatgactaacatatagattcgatttgcaccaactagataatttaatctcttactcctccttgttgacagttggtggggtgcgccttatttttgaagaagaaaatgcttatccagttattcagccaatctcagttgacagcctatcacatgtcaggcactggaaattccgtggtgagcaaaaacagacaagtggcctgctttcaggaagtttctattctgttaagggagatggacagagtgttttaaaagaaaggagtattgtcctaagataattaaaacacaggaacctgacttagacagagattaagacaggcattcctaaggaagtgatacttcactgagttatgaggagtgagtaggagtttagacatctccagacagtgcagcacgctgatttgaggaactgaaagaaggccagtgtggtcagagctcagagactgagggagaagcatgatgcaggatgagttttgagagataaaccatgaaggacttaggccttgctaagcattttggcctttttcccaaaagtacaggaaagcctagccattttattattttataccacccatccattacaggcttttcctgaaaggtctttggcaataggggagctatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattggatttgaaccatatttcttctgctagccaattccatcttatctacaactttttgataattattttgagaaatagatctagatcacagccttccaattcctaggccaggatactttccatttttctacacagaccccattgcagtcctcccttcttcacaatcttcaaaatatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccctcctcctcctcctcctcctcctcttcctcttcctccttcttgcaaatacaaacacagcagggctctatgcagctggttactctaggctctggtaacctaacatagcaggggaggacagaagtcaatagcgtgagaagtctgtttttgtcacggatttgctagaagctattaaagtgttcttcctaagtctgttacttcataggttgagggaagtaatgcatcccacacaagaggactgggatatgtttaaagtagtaggaaggcatttgccactattctagtccatcctgcccatgctgcctaatgtttgttcctacagatcaaaatctcataatcttctagacttctagatacagaagagttggagagatcaaagccttgcctctgacccagattattcgatctcatctggcatatcctacactctagccatcctgacctgccgtgtgttcccctaaagctcccatccttttctgactttgcttttcctcattctgtcccctgcattgaaatgcctttcccacatctctatgtctaaatcttacatggccaattccaacgtaatctaatctctgaagattccctttgctccccagttagaagtagtcactccctgctctgctcactttttgacatatattaatttatatagctatgcatttatatgtgtatgtattatattccttacaagagaagcttttgagagaagggcctataacttttctttctatttgtgtttcccaaagctccttctggtgggaaaaatgctttgaggttgaattaagctcacattgaactctatgatgaaaccatttgcttatgaacttggacaagtttctttacaactctgaaccttctgaattttccaccaggagaatgggaatgaataagtaagaaaacttataagacagctcctggtgtagggcctgactcatgtcaggttcccaggaaggccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacataatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatagtgtagtttctgatgtcaaggaacactttagagagaccttaattaatgtagccatatgttgacttcctggagcactcataacaacatgggaagcccacgctgggaagatgctgagtaggaataagagaacaatgctaagagaagggaaatttcaccgtctgtgaagcgtctgtttagattttatgtttaaactttatgaactctgtcacttgctggtgaattttcttgctcagtatcttaaaatacagctgcagtgtgggttccaccctcttcacttaaaagggtgattaactgtttgtgatgaataattatttaattgccagttcagctacatgtgtgtagttgttttgcttctttcctcttcagtgtgagccaaatcttctcaataataaaaataatccagaattagtcaactgccttttatcatgttctcattcagcctgctggagcaagaacattccaattctacatcacctttagcttaaaaagtaaataaatagaagctctcactcagccagttgatagttttactctcacagcctctcctgtaactaataaagtcttgacttcatcttgaaccttttactctatctttggataaaaatttaatcagaaagaattattgctcttttaatacctgtttaacctttacattcgcgatgggtacaaaaccacttaagatttaaagctctcttgttatggacttgtatgctgacctacttttcctcagagatattttttgcaagaattgttgaagcttgacatggggatcactgcaaatgtctcagctttgccattcactgctttccattcctatgtcctccttgccctgttaattattttaacagagacttgctattttaaggaagctctttatcgttactaaatctttttttattgttaaactcctttttctttccagcatagaagtatgtcatgttttctgtcttcagaatgtgcaagtgcttaccttctcataaagtgtgcctgttaccttaattttatagtctttatcacaaaaaggtacgtaagtggggttcagaatagtgtcttgcacttaaggtttaacttaggttttagtttcttcatgcaagcaacttgcatatgtagagaggcagcatgctatatagtgcaatgttcttcttggtttttaattataaaagtgatttcttttctagtaaaaaatcaagttatgcacaaatatatagagtgaaagtgttttcaactcctctctctagaggaagccactagcagttggcatatttccttccagaatttgttgtgtattataaacctatatacgtgcgtatgtatacacacacagtagtacacacattgttctgcaccttgcttctttgttttccctaagaatgtatgcttgatatatttctaaaaataataatgtatatgggtctaagtatttttagtgatatagaattctataggatacatgaaccgtaactcccttagtcatttctctactgattagtatttaacattgtttcttttttttttttttttgccattaaaagcaaatatctttgtgcaattatcttcatgaaatgttgaagctttctttttttttttttttttgagatggagtctcgctctgtcgctcaggctggggtgcagtggcgcgatctcagctcactgcaagctccacctcccaggttcacgccattctcctgcctcagcctcccgagtagctgggactacaggtgtctgccaccacgcccggctaattttttgtatttttagtagaggtggggtttcatcgtgttagccaggatggtctccatctcctgacctcgtgatccgcccaccttggcctcccaaagtgctgggattacaggcgtgagccaccacacccggccaaaactttctgcaggatatatttttaaaatgggttttccaagtcaaaagtgtatgtatgtttccattttgatacctactgaaatagctctccaaaagtgaaaccaaatttattcttttcaatggtatgtaagaatgcctgattccccatactctcattaaccttgagcatgttccatcttttaaatttttgccaagaagattgtctaaaaatggaatctcattgtttgtatttgcatttttatgatttttggtggatttagcatcattttctatgcttagtaactgcttgcctattcatatcctttatccaggttttttgttttgttttgtttctttttggtttggttattcatgttttccttattagtgtattggtagttatatgagttttaaccctttgtcagtggctaatttggaactcctccacagatccctgggggtttcttagagcagctgactggctggcagagctctccatggccttacctccccttcctcttctccgaactcacacacacactgatcgaacagaatagaccaattattacctgcatttcatgttgggctttgtgcttgagattaaacaaaggttcccggggctaaacgtctaaaaaacattgccatggaatgaagagccctagattttgtcataaagtcatctgtcctaggctctacaatgtagcattttcaaattggaagagccttcagagattattttattaccaacacccatgtaatataaattatacagttaatatatgttgatatacatgcaatactgaagaaatctctaatgcattctatattctgtaacagtaatatgtattttattatttataatagcttcaacatatattgaaaactagaggcacatacgtctataaacagtgctcagggcgtattattttggtgtttatttatttattaggtatttattattttatttagtccatagatgatgcatttatctgagaactcctctgactcaaggcccagcaagaatctgctgcccacagttatgagtagctgaactgggccaagcttttaattctataaatagcgaatctatgtagacactcagctagttagtaccagagtggtacccagatccgtgatgtcttgactcttagtacagtgcacttttccccactttgccattctttgctggtgaccttgggtagatcttcttaactgctcagagcttcagttcttctctcttttaatgagagtaataatgcatgcattgatatcctgactaggatggagttggataaagactgttcttaccttttgtgaatagcatagtatcttacagaattgtgaggaattatccaagtagctattgcccctcatcatggtgttaaaagtaggattgctagtttgaacggtaactgcaggaattcaatgtgttttgattttagcatattcccgtatcatgtagaccagtgttaatatttttagtattttatcttagttcttttttttctgaaagtcttgatttttcccagttttattttttagatttgaaagaaaaagaaaaaggatgtaactatgactcttatgttttcaatctctctgaaatataacaaagtaataactctaaatggtcaacgtagtagtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccaacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttagattgttaatttctttaattattgttttatatttttcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatggaaacatatggacatacagaatgaaataaaggtgggaggatgatgagggttgaaaaaatacctattggatacagtccagtactcactcttcggtttatgggtgcactaaaagcccaaatttcaccactacacaatatatgcatgtgagaaatctgcacttgtacccccaaatatataaacattttaaaagatttaaattacattttctgtgagtagaaacagtttcatttcattatttgaagtcatgccttttctgtttcttgcccaattgccctggctagggactttcagttagttgttgaatggaagtggtgaacatgaacatttttgcgctgttcccaatattaagagaaaacattgagtcttttgccattaagtgtaatgttagaagtaaggttattgaacatgctctttattaagctgagcaagtttccttcttttcattagttttctgggaggtttaatcatgaaagtgtgttgaattttgtcaattgcctttagacataagttggtatgataataagacttttgttctacagctggttcatatggtaggtaacactggttaatttttaaatgttgtatcagccttgcattcccaagataaaccccacttggttgtgttgtactactccttttgtgtgttattggatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcattcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaatttggctaacagtattgtacaagttctctctattcttactgattttctgtcttctttttcagtaaattattagagggatactgaaactttgagcataattgtaggtttgtctatttctcctttcacttgtatggtttttgttttaatgtattttgaagccatactgttaagtgcacatacattaggattgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacaatcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattggttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaagatagccaatatctcttcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatatattgtttcttgactttttaataatcgccattctgactgtcatgagatggcatctcattgtgattttgatttgcatttatctaatgatcagtgtcattgagctttttttcatgtttgttgactacataaatgtcttcttttgagaagtgtctgttcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctagggcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaagagtataaattaaattccgcttctatctgcactgcccaaagattctgtgttttaatactaccctacaactagtctcttgcaactggttaataactgtagttttttttttctgttaccaatagtatggcattcagaggccttaaggcagtaaggcatctgccttagtgttctgcaagtgttcacatcctgtctctcctcagaggcatctatctttccttagatttcaggttacagtagtttccccaactcccacttatcagtagttttgccttctgcagtctcagttacccatggtcaaccacagtccaaaaataggtgactacattacaatagtcatgtagagactattgtctctctacaaagagagagaaagagagagagagagagagggagaccacatacatgtaacttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatgggtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcatataatgatttcagtaaattattgatataaaaattttcaatgaagtataactcatagaaaagtgtacctatcttaagtggccataggatatcatttagactgtaacataagagaactatagatattcacatccccaagcattaactgagaacctgttatacagtgggcatttaggaaatgaaaagtgaaggaaaagttactgaccttaggggtcttgaaagcgagaaaatgattaagtgctgtatacacacacacacacacacacacacacacacacacgcacacacgctcaaagagtagggagagaaaaattatgattggggaaatcaataaaagcatattggagaagacatcatttgatattaacctttaagtatagcagtgtagatagtgcgtaagaattggattatagaacttagtcattatgttaggaaagaaacctatggccttgttttatagcaattactggggatatccaggtcttttgcactggaagaaataatcttagaaccatttattaaggacagacccttacagatcatggggtccaaaactgtcttggggtcgaaaactttctcatcttatagatgaggaaactgaggcttagggaagggaagggacttgcctggggtaaatttttgctagtaaatgtacttaatgagatctctcagttacactgaaacgtttgagtattggaacattgtgcttttgttgttttctttttctttaaatccttaaaaaagttgtggatacatagtagatgtatatatttatggggtacataagatgttttgatatagacatgcaatgcataataatcacatcacggagaatggggtatccatctcccttcaagcatttgtcctttgtgttgcagatcattagaatattgtcttcatcattcttttattccccaccaaagtttttgtaaggtagtaagaggatctttgtggaaagaattcttattcccttacgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctccagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattcctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatagcttctgtatttccactcactcagtatgaagtttgctattattttccccaattcctggagccagttattgcagcaaatttagcatttggagcttatagactcatgctagacagacacatatagaatttacgaatcgaattagaaaaatggtctttgaataatataaattgtactccatgtatatttttatatatgaatgaacctactggactccagtgagattagcaaataccttagctatttcattgcaataaaaaccatttttcagtcactcatgtccctctgggttcttcagtgatattatttgatgtatgctttattctgtgccatttattgtactgagtattttgcatgaatgatcttatgtaatcatcagtaatctgttaaatcagtatcattattattcttgtttcattgatattgaaatataaaagtaggttatcataaattaaaaggctacgggtagtgataaaattttattccaggtagtatctccagaatatgaattcttaatcactactcgtgtttattcattccacatgtcactgaatgcctactatgtctagcaaagttctagattctcttgtagttgcattactcagttattggctagataaccctaaacactgcagaaagctgcactctgcccccttgggattgcctggctccataagattattaccgttgctgagtttggggacccacttgagcaaatctagcatacttaaaaggaagtttttattctggagaagttttgttaacaaaacatctattggctgggcagagtggctcataactgtaatctcagcacttcgggatgccaaagtgggcaaatcacctgaggtcagaagtttgagaccagcctggccaacatggtgaaaccctgtctctactaaaaacacaaaaaaattaggtaggtatggtggtgcacgcctgtaatcccagctattcaggaggctgaggcaggacaatcacttgaaccggggagacagaggttgcagtgagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataagcctgggcttaagattgtatctctgagtgagacaaaataatagatgattctatctccctttagaaaaaaaagaaaaaaaaaaagcagcagcagcagtaattgactcttacgcttaggcaagaactccacaatggatttgttggggaaaaaaaaaatgttttcctgcttgtatgtgttggtttagattttctgttgtatgtgtgttgtgaaagaagactttggataattattgcgattttccaagcagctggtcttccaatggcattgttacagggtcagtctattttcctttaatctgaccataatgtcatagaacactggctgtttctttggcaactgttcagggaagactagctgttttctctacctcaagccaatggtggactgcaggcaggttctcctgcaagccacagggaagcagttttcattactggggtctttgtatcaacaaatcacttatttcactgtgattctgttgagacaggatccgaaagtaaatttcataagaaaaaaatgattatacatcaagctcaggtgactttaaaatttttcctttacattgagtaaagtttctggccacttttgaccttttttttcaaatgacattattgatatgaaatcagaaactataactgataaactacaaactgctgtatagacacttttctacacaatggtcattgcttttattctttatctaagcctgaattgtaaggcttccttctctttttttttttttttttttttgagatggagtctcgctctgtcgcccaggctggagtgcggtggcacgatcttggctcactccaagctccacctcccgggttcacaccattctcatgcctcagcctcccgagtagctgggactacaggcgcccaccaccatgcccggctaattttttatatttttagtagagacggagtttcaccatgttagccaggatggtcttgatctcctgacctggtgatccacctgccttggcctcccaaagtgctgggattacaggcgtgagccaccatgcccggcctgaatgattccttctcatcttctgggaggtttttctgacttgctttctcaattccactctcttaggcagagcttatacctcccttcatgtatgttacatgtacatgtattgagtcagtgcatcctcctaatgaaacttttcctgagatctctcttatttactttcttccttttctgaaattctctgctatttagattcagtgccaaagaaattgacatttttatttacttgctgaggaataaacagaactcgaaaggatttgggaacccaagaccaagttttatgaaataactaatcttgtcttcctaaatactataaaaatcttatataatccctaatacttagcatagtgctaagcaccgaataggaatacaagaaatattgcaatgatctgaattgcttacaaaatattgacaacaacttcttcattggtaaagaaaagctgcttttgacctttttttcttcctcaagagtaagtagtgagaagcataaagtacccaagagtttctttgcctttttgattgttgcatggaaacaagtatttgcaaataattaagatgggaaaatttggctccttgaaaaggcaggactgctttcagatatatttgaaatgaacttatacagaagccaacatggttatcagagcaattgggtctatttcctatcatctcttcatgatatcttgtaaaaatgccctgtgttgagagcactggtgatcatagcagtggggttggagtagaatctggtgcgtttcttcctctacagatctcctaatagcacttgccctgttttcacagagccttatcaaagtttgatgtagactccagtgtgtagtagtgggcagtgacctaccagatgacctctttgaacaagagctagtttgagccagtgtatagctctgaatcgatggaagatccattttcaaatttcaaaagggctgttaaaacacttagttctgtattatagagatacacaaatggatataacaaactggatgtctcttctgcagctgtttcaattcgtatgccatgttttctatccttcttgctcctggcaattttctttcctgaagcatatcacaccttcttacatttgacaagcattttcacagctactgccactccctgctgccaaacaaaacccagccctgtttgaattcttgagggctgagggatggagaggagacctgtttgactttgaaatggttttaacgtcactttgtatacagaacaaaaatggaaaaccagatcctgtgtttgtctaaaaactaaaatttcaaaacctaacctgaggtggagaaacagatactacagggcaaggaaatgtctgggctcaccgcaaaggaatgcagcaagggaaccacctgcagacacctgtttaagagtttacgtttttgttcttccacacgattattatcttagtatctcaactggctatacatgcttttaggaaagttgcagggatcatattctaaggcgtatcaaatatgttcagagtgcaagcatgagcagaatctctcctctctgctagtgaggtcctgtaggtctacaagttactaacttcaggcttacagaatgttagaagtaacgggtgcatatcctgtaatcaatcccggtattgagcaaacaggcacaaatgacacccagcaagaaaaatgacttgctcaagacaccacagcaagttcatggttttctgaactgaattccaagtttcataacttctaattaatcctcctttttttcccccagtacagctaatatgctttttgtgaataataacatataataggtgtaatctgtcagaactatttaatagttgatagtatgtatcctcagtttattgaggttcaagctcttctgagtattataatactttctattggtattttctctcttgagctattccctaccttgaatctttcagactagagatttcagaagattacgtagtgtctgtgacttcaactacacatggatagtccacaggactctggactttcacggttccatgtcagttggacaggtgttactctaaggccctgcaaaaatataaagtagtttgagaatcactctcctgttaatcttcagtaaaattctgagctatttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctatatgtcaagccactaactgccagccatcagtttgaaaaccgaagcaattaagatcgctgtccatcttacctgaaagggaagctttgcactctaacttgaagtagcctagaaatttcagaaggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgtgtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattaacttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatttcctcttagaattcattctaaacttctttaacagaaattatctttttttgattcatattctcccttttgtcctggttaccagacagcacaagtgaccatcatgtttagatttctgatacagttctctcttccattcctctctgtagcctctgatttttttttcagacttcagttggaaaaatcctaatgaatgtaacttttagttacaggttgaattcttttgaatgtgtatatttaaaataagtaatgcacatagttaaaaagaaacatgtttttaaaacagtggttctcaattatagctaaatatttagaattatctggatggttttaaaactctgatacccaggcagcatcctagatcactcaaatcagaatatctgggtttggtcacggacatcagtattttttttttaaagctgcccaatgtcattccaatgttaagattcattgttttagatattctttattatgatgttcatcatttttacagaaacacatttccaaaaggataaatttcaaaatcacctgtaaacccataatttattataagtcactcttaacacctaaaaatagctaacctgctaacctttttcttttgctttttccttcttcttttaaactaaaattacaataatatatgtgcatatatagtgaatgtattcatttatatattagacacaatttacatatttatgcttatatatatatggcatacatgtacacgttacaatatgtgtatttgttttattccaaatctgttttattctcagagacattttcccatatcttcccagatatattttctgagaacctggtttttaatgcttgtataacattaatacttgtagttagaccattttttttactcattcttctattcttacatattaatgttgcagacaacatccttaaacaacttttgtgtgactaatccaatttttttccttgggaataaattatgatctattgatttatttctatgtgggctgaattttgtccataagaatgaaaatggtagccccctaagatgctgtttgctccctgatatctcatttttctctagaatacgaaggaatggctgttttctgctcttcctaaagattcaggatgtaataatatactgtcacaggtttcagaagcatgggaccttggcaccgaaagggtctctactagctaagttgtcttggaaatgagtgggtccacttcctcttctgatacaggaagaacagggaggtcattaaatgatgacggggctctttgaagtgaaatgaagcaacattggagggtgtagcatgtaaaaactctcttctcggatacaaaaaaaattgagctacttgggctaggagaagtgagcctggatttggaggcttaaggtttcaggaaggtctgagacaaacttaagaagaaatgcatcaagagggttggaagggacagacgattgatgagagcactgaaattccagtgtgatttgggtcacccgtgtgacatggcatatatttatgggatacctggaaaataagggagaaacaagacatctatctctgtcacactttggggaagtatacgattaagttccacactctgtggtggaaagaatgtcctggaggcccccagtctttctcactgtgatgccatgctcatttgataacctcataaacacatttctgttcttattgccttacccattctgatgcactgatcattttttaggccatgtgaacagggcagagcttgtcattatgcctgggacatagtgggcattcagtaggtgtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttataattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgagagagtaatggaatgtgtatgtctctgctcttgaagataccaggggcacctcgaaaactcccctccccagcccagggtcaccacagccttaaccgactgcctcctttgcaaacctttaccatgggtacctagaaaaagacatacacacacacatttcagcttatggtttttgttcgtttgtttttgttttttgtttgtttgtttgttttgccagatacttaagatttaagggcaatcttaagggaaatctcttctcccatcttgactgaggcacagagatgtcctgttcccatgctgttgatgctgacagacgtaggacacgtttttttctccgtgtgccaccacactcaagcagaatgtataagatattttctgtctaccaaggatacctggtgacataatcatacctagcctttctttcctccctccgccccctcagcctctcaccctgccctcccatgggtctttatgtgtgctactctatgtagagtacaactcataccggatagcctgttacttattttggttcaggagcagctgcagaggatgaactggagaggacagtctacttgcaaacacttgtagactctccagtggacaggttacctctaaagaaagagaagcctacgctttcctactcactgaagttttttaccatttgcaagtggatccaatatatgtttgttttgggtgaggggctaacaaaatgctctgcggtttctgcaggtttccttataggagatcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgatgataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggagtttccattctagtggggacacaataaacaaaataattggcaaattatatagaatattggaaggaagtacatgctgggagagaaataagctgggagggaaaagggagtgctgggggagaaggagctaagagtctcagttccagagttaggcagcctgagctggaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctcaaaaaaaaaaaaaaaaaaaaaaaaaactcagctgcatccttcccagtcatgtgacctgggcaggttaagagaactccctgagcctcagttttcttgtctgtttatcaagagtcattagggaaactagtatctccttgggttgttgcagggattcaatgagatgacacatgtaacacaatcattacctcgggcctgtctcctataaatatagtgattgtcacgtttgttatttaaacaatattatatattgtgttttaggtattatgtatgtaatatatagtgtgaatatatgtatgcgttatgtatatagcattatctgacttcgtgcctctagtattacatgcttctcaaaatatctatagttttgtcggtatttctttctcctactagattgtgatcttttatcggcaaagaccacctctcatttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagttgcatgttactaataaggaatcagaagctcagagagggggaatgaaagaatccaagtatatgtggctaaaattggccacgtcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgagtttattggacactgcagaaattcatttacattgtgtgcttaccctggattgttgttgagtccagctgactgttgcttcacaaattaactgtcctttgagacttggaaatattgaaattgcatagagtttttgtgaaatctcaatcctgtagtattgtgtatattacaacaggtgctcaatagacttctggattattaaattgagtaatatttgtagcaaagatctgtaggctgaattataaagctaatctgtggggggatgccaagatttctctatcattctgctatgtttgccatggtctaccaggagatggcgcctggtaagagttccatattttaatgtattctggtccaaatcactggagttggcaaagatggagaaggaggaactgagcagttcatccccaaagacatgatgacaccactataagtgtgaagccagcaagagtgcaaagactgagagcagcgtggtcatacctagacatttatctggagagcaaaatcaagcactggggctcaaagggttcagtcccagcagttaggagagagaggagtctcctaggagtagttgccccaacagctgctagaaagtcctgatcctttttggtctgagccaaccaggtctcagcccagtcccacttgcctcaatttaaagtgacatttttggtctctagctgggtgcttccccctctgtagcatataacaaggatacactttcaaggcagggagcctggaggacaaggagataaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgctataccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgttggggtgtaacttaccatgattacatgttgtgatatacgagtccatctcagcagatagagagactctccttgacagcttgaggaaataagtgaccatatgagagaagctcatgaggcaaggagctgtgagcaacctttaggagctaaggacagcttccagcagacagccaacaaaaagctaggatcctgactcacatacccacaaggaaatgaattccgccaataatctgaatgtgcctggaaaagattcttccacagccaaccctccagatgagaatgctactcagctgacactttgattgcagcctgtaagactccgagtggaggacccagccagagtcatgcctgggccctcagaaactgtgagatagtaaatgtttgttgttttatgccactgagattgttagccaacaatcaaaacctaatacaataataccctttactgttttctagacagctgctatttagaaaagcctcccacccaataaaagagtcccctttatagttttccaagtaggtggttatcagggttctgcttcaccatcttcagtggcaaggaacttccatttcacagggcaaccatgtgtgtattacagaggcttgcatgttgtcaagttcagctgtggtcttcagcgggagcctaggacatgccagggatttcaaggtaggctggtgaggggttcctggttttcttggtcctgaaccatcccagtgccattctaacagttgcaagtctgcctccttcatgacaaaaggactggaggaaaatgtatctggcaagtcgataacactggatcgtttgctcccagctttaccacttggcatcagtgcaaactttcacccagttaaataacttaatgagccctgctctgcatgcttgcttcacagagttgtgacgatcaagtaagacagcatctatgacagtgtttgttggctgtaagtcagcaaatgattgcaaatgatgattattattaaaataatagtcatttgtcagtaaatatttgtcaaagctggtccacactgagggagacaggctctccagggaaactgctgatgcagagataaagaggagaccagccccagtttggaattgcatcactgattctgaattccccatggtacatttcaggtcttgcttcaggaatttgttttttgttttgtttggtaggaacaagaatcccctagagccagttatgttgtcatcaaacttagttgctaattaggcaccaaagcaaacctatgccagtgagacagagttgaaacttgaattcctttctgcaggtggagcgttggatcctagaggcggtgtatacagcttggctattttgatgcttctgcatgcaagaaggtttaagagaatctgagtaaagcaattagcatccctctgtctgcaggcaaaactggtttggacatgcttctctcttcttgaagggctgttagagccttggcagtgtatctgacgaaagatttcactaagcaaaatgtcttcacttacaaatccagccactttgcactctcagtcagcctcaaattcatttattttctttagagtttccctacaaccacgaaccaccaagaattaaattaatccccaagagcctgagcaattatgaggatgttgaatctatccattcaaggatgtcccagcaaggactgttcattcttttaacgtaaactatttatatgttttgattctcctcatttggaagaaagaaataagttttcatatatgtatttttcagggtgtattttatatatctgtttatattacactgttcacattactattaaagcatccccattttattgtaagtttattttgcctgcttcgggaagaacaagaccaagatcccattattaaaaccaaaatcttccacaaaagtttccttttaaaaacttagattaggaaattttcagtcagccagccaactctatagcctttgatacttggtcctacaaagttttcttcccctttggtctgaatgttttcctttgtctgtgcacactctattctcctgccagcatgataatacatgctgctttgatatcaagtggcgggaacatatagaaatgtgctattggtgctgcaatttgtatctttgttttcatcaaacttattatttaccattttaggatttttttgtttctttttgggtgtttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaaatcagctgggcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtaggatcatgtttggcttttcaaaactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttggcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttttgtgttctttgcagtagagtccaaataaatataaattaaaatgtttccaattacagaggaaatattttcagtatcttcccacaaataacactgggtttataaggcttggttcccgggtttcatggtcatgcttggttgactaactttgtgttcatgtggcataagattctaaactgtcagaactacgtgggcttttagagcccatctaaatccttctcactcacagacgagcaagctgacatatttgcctcatttattggcagtgaatgaattaaaatattgtgccttcatcaagatattgtgtgtatattcacaatgttgtttttcataaatatgtagcattactctgttttgtgactgctcctagactggctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaacatatgcaaacttgtcttattaaaaagcctatctctagtggttcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcatatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggcacatacacgccatggaatactatgcagccataaaaagggatgagttcatgtccttttcagggacatggatgaagctagaagccatcatcctcagcaaactaacacaggaacagaaaaccaaacaccacatgttctcactcagaagtgagagttgaacaatgaaaacacatggacacagggaggggaacatcacatactgggtggggcctgtcgtgggggtcgggtgcaaggagaaggagaggattaggacaaatatctaatgcatgtggatcttaaaacctagatgacaggttgatgggtggagcaaaccaccatggcacatgtatacctatgtaacaaacctgtacattctgcacatgtatctcaaaagtaaaattttttaaaataagaagaagttgaagtcagggtataggaatcacaatttgcagtgctatctttcacacttcttaccacctgatgaaaatcaccaaatagtatttcttcttttacctaacatctctaggaaagagagaaccctgactgcacctacaagtagggaaaggcatttgagttacgcaaagctgcttttaactctgaaactgtcctacagtgtagcatataaacagggaaaacattttattggtgttttaatagaatcttatctaaatatctggaatcttactgcaagggccgatcattactctaggtagatttcaaggcccacagctccattatgatgtcaacaaggataactgatgtttattctgtagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggcgcctgtaatctcagctactcaggaggctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaacggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatattgacactcccaaggataagggaaggcattacatcatcctttgtaatggtgaatcttgtgcatttgtagagggctggactttggcttctaccatattgtttagctctgtcaaccccacacaaggactttatttatttatttagacagagtcttgctctctttcccgggctggagtgcagtggtgcaatcatggatcactgcagccttaacatcctgggctcaagtgatccttccacctcagcctctcaagtaactagcaacacaggtatgtgccacctcatctgactaatttctttttaattttatatagatgggatctcattatgttgcccagcctggttttgaactcctggccacaagcattattattatcctcatcttacacatgaggaaactaccagtgaagtggcttgcccatcatgtgaaattacatatgccagtactagcctgttctgaaatccagcaacattcttttccacctctagccttgtttctagcaccctttggcctccagagcaagctggggttcattttacattaaaagtagagccatctgatgtggcgggcatccaaaacacttgggaaaatgctactctgtttagaactcgcttttcttcctcccgggtcccagtgcaggaggtactgtgtgctatgtgggccatcagactgtccctggccatggcaggagaattaggagaccaccagggctgtagttaactgtaggtccttcattaagaccagccaattgatagcgtgtgttcatgagtccttgtgaagtcttttcatcagccacgtggaagaccccttagaaaaacaatctctgtaatttgtatttttggacatagtgctttaggaaggtggatgtctgaaggtgggctgggtttgaaacatctctcaatgccatgggacagtgtggtacagtgtcctgacaacttaagctcatcctgacaacttaagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgatccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagcttaaggagattttgggctgagacgatggggttttctaaatagacaatcgggtcatctgcaaacagagacaattagacttcctctctttctatttgaataccctttatttgtttctcttgcccgattgcactggccagaacttccaatactgtgttgaataggagtggtgagagagggctaatttacattcccaccaccagtgtacaagggttcccttttctccacatcctcatttgttttttccagaagacagcatttgctattacctgtcttttggataaaagccattttaactgaggcaaaatgatatctgattgtagttttaatttgcatatctctgatgagcaatgatgttaagcagcttttcatatgcctatttgccatttgtatgtcttttgagaaatatctatccatatttttcgcccaattttacatcagattcttagattattttcctatagagttgtttgaactccttatatattctggttattaatctcttgtcaaatggatagtttgtaaatatgtttccctttcactggtttttgtcttcattttgtttgtttcctttgctgtgcagattaacttgatgtgatcccaattatgcatgtttgctttggttgcctgtgtttgtggggtgttactcaagaaatctttgcccaatccaaagaacattcatctttgtcaaatgagctatagaattaatgtttttcctatttttatttattcattttatatttatttctattttatatattcatataacaatatatttattcataatatcactttgaatatcatttgttttcatcttgcatttttctcatttttcattgaggcctaatttacatgcaatgagatactcagatcatgagtcgtagttttaggagatttggcaattgtatatattacccaagaaagttcccttaagttcccttattcctctttctattcaagtcccatctgccaccctcagaggcaatgactttctgacctctatcaccagaaattatttctatatgttcttttaaatcagataagaatcacaccatatttattttttgtatctggattctttcattttgtgcagttgtctgagattcatccatgttgttgtattagcagtcttcatctttttgttgtttagtatgccacgattataccataattaatttacccatttttcttttttatcataatcttatataagggaaaaacatgggaatacatgaactgtatctttggctcaaatccatcttctatcagttctaagggcctcagggtatttgccatgaggggctgtgacaccagcctggactattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaagtatccaaagcattggattacttgagataatatttctggtcctcttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggatatgaacagtaaaggagaatatttttctagcttgtgttaaatcaataatgtagtgattccaagggaattgagaggttcgtgtatttattcatatattagtcaaaaattcaaaattctatctctaattaaaaaggaatttgagaagtatctaccatttttattgtccatctctttggacatatgctttgcagcacagtggagcggaaggagcgtagacctacagaaatttagagggctaaatttttaatattggcctggctacattgcctggactttgggaaaatcacttaagctctcttagccttagtctttttatctgtaaactgagaataataatgccagtttttcaaggttgcattgaggatcttaggtaatacatataacattcatggaacataaaatgtgaaccaatgaaggtgccaatgcaattacaccttcattaggagttgtcatttctgcggcttctcattagaacatcaaaattagttccttcaatctttactgaggcgcagagctttaaactctaactttgaaacttccaaaatgaagtgtgaaaggtctgaggccttgtgagtttgaaaatgcagttcacacttcattttagaagctccagaattttttaccaaattgagattggattcaggaaatcatattttaaagccctggttcatgccattttctaaagaagtacctagaaggccataatcagaatgcttattaagtgaccacactttgaactgcattgcagataaattacctctgtgtggggagatgtgtcttgagattctgcggtcaaggctcagacagccccagagctggaaacctcagagcatttatgcctctgtcactaaaggatggggttatgggggctggacagaaagcttgagagagatgaaaagttcagtgggcttgagggaggattactgaattacaataatatccacaccgtaaagtgaatttgtacttgcaagagacacattatttatctagaattttagaaagggtctcttttcaggtcactgtgtagattgcctgtgatttgttctccttgattgaatgtgagtgagtgtgaagcatatctaaacaggtctcacagcaagtttctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccgtctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgacagagcaagattccatctcaaaaaaaaaaaaaaaaaaaagagagagaaaagaaaagttacatgtagagaactgtaagtaatcttatctggctagaatatagggtaccataggggaatgactgagcatgggtcagagttgtaaacatccttatcatgccaatgagttggatttctccagaaggcatagagagatctgtttatagtttctaggtaagaaagagtttatgaacttgcctgtgtcttcgaaatatgctgtggcagaatagaaaaggtgatcaaccagagtaggacagaggccacacacatctgccctgaggtcagatacctatacatttattgtgtttgatagccaaatgattttaatgtaaactagttgcaaacatttaaaatttgggaaattttacataaaaatctagattttcgagcttctattaagaagtagagtgcacaatatctgcctagcaagaaacagctgttgctgagaagtgtcttccaccttcagctagagcatgcagtctgacatttgcttttctggttcttgtatttgagtgtgagactcttggagtaaagcaaacccagggtcagaaagatcactggtgatgatgttgcagttgtactgtcaggactgatgaaaacctaaactaaggtggaagccttgaggaatgaagaggagggcaaggatggatttgctgattgtttagatgtgtcatggatgaaagagatggagaaatcaaagaagactctcaggttgtaattttaggtaactgggtaggattcccatgtagtcagaaacccagaaagaagagaaggctttgggaagatgacagtgtattcaatgtggctttttgtggttcaagactttggaaaatattgattagactgttgaaaagtacttataggtcaggaacctggtcagaaagtattgtgctaaaataatattgttatgacccaagcagttgtaaaaataacttttattgtctaactctcacagtttatcttgaactcttaacaggttgtcaggcaaatatctgttcttgaaaccagaaaaacaaatcaagaaattgggatatttgaaatgcctagagtgggcttataactgtaaatgatattttacaatggaaaagtagaaacagtctttagcagccaatgtgaaataactgggtaatgttatttaatagaatgcaaatttgaaatgagtgataaccattatggagaattttgttaggaaaaaaattaataaagtgaatgtaacacatgaagcagagctggaactaggaagaaggaagtcaggctcctggggaaccaaattaaggagacttcccctctcaggcacttgtgggaccctgacggtaagcatctccttaggtactgctcccatcctcatccttgccttgagtttttgaaaaatatatgttagaaatgtttatgattatatatcacaaactgttattctcaattttatgaaattccctagatatgattacaatagtcatttgagatttatgatcttatctaattgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgcgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattcttacctttaaaagttagctatacaagtacatcatataaatgtcatttactttgatagctgtttatattttttaaaaaaagaaagaaaacaagactggtagagaagatagtctgaccgcaagatcaacaataataataataatgtaggaccacagaaaagtaaatgaaatcttggactgcattcatctaaagaggagcatgcagaacagggaagcagcagtgcctggagtgctgagttcagttctgggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctctttagggctgttaaattgaaaaggcaacagatttgtctggagaggacagaagtagggccaatggggaagaagatatttatgtcaaaataagaaagctctaacaattagacctaccagtggaatgaacgaaccaagagagtgagctgtccctggacatggtataagcagcctcaggggctggaaaaacactgactgactgggaatgttgtagagggaatttatagatcagattgattggggaaaatagccccaaaggttctcctctctctgacatcactctatgattctatgtgaagttctagctttttaactatttttttgtataattaaataatttgtctttattgattgagaactaatcattaaaaaagctactgtcttttcatgtctagagatgataagaataatactacatgcttttgaagaaaaggaattttatgcaaataatcccataccagtgtattacgcttttgcagggataatcaagagcttgcaaaatttgaaaccacattttcccctgtatggaggaggaaagtctattttgcatccgtactttatgccttgggcattattattgctcatatgctctaggatttttaataaacctaacctgcttcatgaaattacactgcattaattcaacatggccatgtccaaaatttaatattcattcatttattcaagtatttattcaacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaagaaatttgattgtgtctcaagtgggcaagtttggcttggggtctttcatgaggtttctggtgtgaggtctctcaaaggctgcttctccttacacctgggccaggagtgtttgaacagctagtctggaacaacttggggtcttcaggtatctccctctatctgcatgtggtctctccagctttgggataacctaacttcttacatggtaactgctatagtttgaatgtgtcctttaagttaatgtgttggaaacttaattcccaatgcaacagtgttgagaagtggggtataataagagatgattaggttatgagggctctccccttatgaatggattgatgccattattttggaagtaggttagttattgagagagtaggatgttataaagtgagtttgactccctcttgctctcttgctgtcatcctctcttgaccttctgccttctgccctggaatgacacagtatgaaggccctcaccagatgctggcaccatgatcttggacttcccaccctccattatcataaaccaagtaaatttatgttgttcaaaagtgacacagtcagtggtattgtattatagcaacacaaagcaaactaagatagcaactgaggacttcaaaggtatgtatttcaagagaaaactatatcacattttaagattagcattaggagggctgggtgtggtggctcactcctgtaaccccagcactttgggaggccaaggcaggtggatcacctgaggtcagcagttcgataccagcctggccaaacatggtgaaaccccatctctactaaaaatacagaaaaaaaaaattggtgagcacagtgtcgggcacctgtaatcccggctactcaggaggctgaggcaggagaatcgcttgaacccgggaagtggaggttgcagtgagccgagattgtgccagtgcactacagactgggcaaaaagagggagactctgtctcaaaaaaaaaaaaggttagcattagaagtcaggcagcatcactgctatgacattctcttggccaggcagttgcataggttctcccaagacctcacctcttagtggtggactgttagtatcacattgtgagatgggatgtgttttggtgtagtcatctttgaaaattacaacttgccatagcatatgaacagataacactatacttgggttctctgctatggtgctgtgaaagaacagaagaggagagtgattaacagaagaggtaacattcacatatcatgggccatataatttgatgtatgtaacttgttaaggaaatacgttcaaggcaggggcaacagcaggtggaaaggcatgaaagaacaatgagcacaaagtgtttaaaagcttgggttgacaggaacaaagactgagttgtaggagaggtgacaggctaggggcctagacaggggaggtaggacagcatcctgaagggccttgaacatcaagttaaaacgtttggctttggggagcagtcactgtctttagagcacaggcatataaactgatcgtctttggtaatctcttccatctacaatctttctttcctttgatagtaaacatatcatctctgttaaagttgcttcctagcttaaactgaacacagactccaaaccattgaagcactttagatttttttcttttttttttttccttttcttttactcaccacaaacaactctagaatggcatgcatttgaacaaaccaaaagtgatttcactcttctaattttcagtgctttttggctaaatgcagagtgagaaattcatacctttttcaagcagtgtgggttctttttcccaatttctgtcatccatctggttctctggaggtcttggaatccaggaaagtgttagttcactgtgctgaaatccaaaaaagactgctaaactgtgaaagaaaatttgcattccagagacactgaaagagttagtccaccacccttttgcaacagcaaggagaaaacatctgtatttcctgcctctttgtctttaagcagttatagaatggaaaaccctatactccctggctgtgcgtttcatacctagttaatctaaatcacttttggcagggtgggggaggaatcaaaacatggaattattttatttctagtgtcagaaaatattacagccaagatactgtttaagggaagcaaattacttcaccagcttccttttgagctcctcatgaggtttaattctcatgaatgggtcctagagccgacatttgacatacacatcagcagtgccctcttcggaagggaaccgcacagtcacagccatgatgttggcatgtctttatggccttcctaagtcatgtgctgtcttttgtcttccattggcagaaatacaattagaaggccttgttctcaacagaagccaaatgattgccaaatctgttcaactgatctctagagaattgaagttagctcatggccctctggctgttctctttgccactcccaggagttataggcttaaagttatccctttcttttgaaagaggatcaagtttggttcaaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtatacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttataatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgtgcaacaatcttgttttgacagcgacaaaacccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgtatggatttggggtataataaggtttacacagaagaagagctttttcacaaaattcccaggaaagcagggggaaactcacttagaaatctagaagcccattttatattatgacattatccaattatcccagagtatcatatacacaattccttagataatccatttgttgaaaggacagatataaaatataggagaattaatggtgaagggaaaaaatagaaatacggtgcttcagtgtggtagttacattaaatgatcaaaggatgacaagttaattgaataaatgtcttagccccttgaaatttgtatagggaatttataaaactaacatttattatatagtcaggactgggttctcgctttgataatatgtgaactcatttaaacctcacaacactgcaatgtagacatttcagtctacaaaaaccaaaggccagaaaggtcaagaaaattgcctagcttttcgaacccagatcacctttttcctactgtttcactaattctcttactataatatggcagaccttctttgatgtctgagttaataaatcttcacatgacttatgttgtaaaggcaaaatctatcatttgacttgtctcggaaggaaaggaactcaattcttttctttctctctcaccatagtcttagtcttctctgatatgttcattatgcccatggcatgagggtctgacccacagtcctcagctcttaggccccttccccctgccccacatttttcaaggatcagaacacattcaaaagaagtgttttggaagacctagcatgtcacatgggttatgcattttaaagtaaaatattacctctccgggcattaaggtataaataaactaaatgttctataattgagattttcttttccgatttagtaaagctcagatcacaatcctaaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagttttttttcaagtgccaaatccaatcccaactagaatagattcttaagagtcatagaccaccaccatactgcctgctctctcaccattcataagtaattactctcttctctgcattcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcatctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatcatttgggaagcaatcttgatgaccagaatcaaggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattacttatgtaaatgaagactgtatatcttgattttaaatactcaaaattgaacacttacatatacctatgtaatatgtaaataatggtaatattcttattctttatcatctcattagtagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactctacgtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttcttgataactaactgtgtgcaaatctgcttcagaatttgtttcctaggaaacacaacctcagactatggcttcatgggaggagagaggagtgattgcagtttagtcatagaggttgacataaaccactaaatcaagtacattgtgttcagtgtcataggggaagcataatacaatcctatgggagtggaagaagttacttacttttcttggaatacaacagaaaaagatttaggaaagatttttcagaagaggtgacatttgagtttcactttgaagaatgagtaggcattctctaagcaaagtagaatacaagatagtctgggctggtaaaagaatgttgcttattaaagatgtggcagaaagctcagtgtggcagctgggaggaggagtccatgggaccacgatggagctggatcagcagtccagtcacaaagcacgctactgatattgaaggttcataagctggaaggtgctcttttcttttaaatccccagctatcaatgctggcaaccctactagacaaaaaaataaataaataaataaataaaagaaaaaagaaaagaaagaaagaaaaagaaagagagagagagagaaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcgtgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggataattcatattcttcacctagcaactttcctttttcatggccacataatgaattccttagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccattacagggctgactaaaaaaaaaaaaaaaaaagtaaaaacccacagaggagcaaaacacaagtcctgggaagacaatttccagccacattagctcacattgtcagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattcgttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggcacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacagacacttcttgcttcatagccatttatatatcctcatggtaaaagagcagctacccctgaatttccacatcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttctacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaactatgcccatgggtcaaatccagcccattgtctgttttttttttgtaaataaagtattactggaacacaagcatgcccatatgcttgcatgctatgactgctttccagctataatagcaaagttgacttgttacaacaaagccagaaatatttactatatgggactttagagaaaagtttgccatcacccatgctgtaggaaacaagggaaggaacaaggatagcagtcagaaaacacatgtcctcagttctggacttgccacctactacctgagtaatactagaaaagccacttgacccatctaattgtgtttccttctctctataacacacttctttggccagtttgttagttaattggccgataacacttgttttctatttgtaaggactgtattaaagctgtagatgtggtttgtaaatggtgataaatgccttccttagagtggtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcgtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcatttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaacctctgcctcctgactcaagcaattctcctacttcagcctcccaaggagctgagactacaggcatgcaccaccatgcccagctaatgtttgtatttttagtagagatggggtttcgccatgttggccaggctggtctcaaactcctgtcctcaagtgacccacctgcctcagcctcccaaagagctggtattacaggcatgaaccactgtgcccagccaacgtttggtttatatttttaagaactgtactaaacctatagatatgatctgtaaatggtggactcaggtttctgtatgtgtttgctgggcagtggctttgaagacagcctttgaggctatcaaagagatgaagcttgtattgctcaccaggttgggtatccattctatggcttccaagtgtgaagtcttctgggttaattctcaccactgtgttgattgtcaacagccaggaagcacttaccccaaggagtttggagatctgagactcatattttaagaatgaatgtcctaaccactttccaagtagcaaagaaagtgaaaacctcaccaaaagacgtgaggttgaatgaattaaaaaatcccagaggcggaaatttgcaacctgaattagacaaggaaggactcacttttaaagggcagtcacagcataaattgtgcttcacattattgatatttttagcttgtaattacacattgaaaaatccctgcgtcttaagggaagtgaaaagatctcaatggggagtatgttctgttactgtttctctcctttcttagacttatcctaatccaagaaagactgatacttataatcggagcacacatgtttctgtggctagaaaagactgatacattacacccctcaattaaaacaggaaatcaattttgacaaatgccaatttatatctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttataagccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagcttgccaggaggagggcagagaaagtgtgcagacagggagaaagggctgaactccatgagacaggcacaggtaagggcttgcactgtcaaagtcagatcacctggctctgtggtcagaataggctttgtggacggagaatgtcaagagtgttttaagtgggaaacaaggagattcctggcagagggaacaactcaggcaaaaagcagaggcacagagttagtaaagggttctctgtgttcagggagatttgctttgctgtaactagagcagcctgggagtagagattaccttgagatacaggagacccataagaagggatttacctcacctgcttagcctgccttttatttatttatttgtttattttatttatttattttgagatggagtctcactcttgtcacccaggctggaatgcagtggcacaatctcagctcactgcaacctctgcctcccatgttcaagcaattctcctgcctcagcctcccaagtagcttggattacgggcacccaccaccatgcctggctaatttttatatttttagtacagacaaggtttcaccatgttggccaggctggtcttgaactcttgacctcaggtgatccacccgcctaggcctcccaaagtgctgggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatctttcacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgtatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatcgaaagttgttttcatcaaatttacttttacgattattgtccactcagtgagctaagccttgaaatagaccacctgggattgtgagccctcctcgaattgctatcggaggaacactgtggggactatgagaaccacctcctgcctcttcgctttggtttttctcattatggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccacttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccacctcttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctgtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactactaattgctcagtttcctgaacgcctctagagctgcagtatatctgcatgttcttttcagtaaagccaaacttcccgcagagtataaccattgctgctattgtgttctggataccccgttaacttaaatttcattctatgtcaaatgaagacatgaactccattgacctccttgccaccatggtagatagcagaggcgaggttcatagctgttgtggcctttgagagtttatactaaagttagcaaacacacacctcttgatgaagtactatgtatttattttccaaagaaacttctattttctccaaagacaaaggccagcatttaactgttatataacacttttcaaaatggaccctaagaggagctgtcagcggtagtatattcctttacagttatgcagttctttgcatttttttttttgatccattatcttctttgatcctcttaacagcttggtaaggtagaaaaggcagaagttattttcagagtggcagtcggcctgtgtgcattgaggcagactgtagcaaaactgtgggtggtgctcaggaggcctgtcccctggactagcaatctttgctctccacaatgctgtctcctttagaaagtacagcaaaccactactccccacaaactttaggattttattttcttactgcagttgaagtaaatacaccgaacccactggtggcccttctgcttggcagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatgggagccaagatgggtggcctcttctcttcttatacctgtatttcatatcaagtgagcttaggaggattatatttatgtccatttatatttatgtccccaatctctaattcaattacattcaagatatactatgttatatattgggagaaaggatacaggggattagcagaatgtaaagcaggaaggatagtaagtggccacattatggaggccttgaatagaaagctcaatcatgatgttctccacatgtgtacttaacgtttttacttatgtcgtttccatctgtctttactgttctaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctagttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttcttttttttttttttgagacggagtctggctctgtcacccaggctggagtgcaatggcacgatctcctctcactgcaagctccgcctcccaggttcacgccattctcctgtctcagcctcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctactaaaaaaaaaaaaaaatacaaaaaattagcctggctcagtggcgggcgcctgtagtcccagctactcaggaggctgaggcaggagaatggcgtgaacccgggaagcggagctttcagtgagccgagatagcgccactgcagtccggcctgggcgaaagagcgagactccgtctcaaaaaaaaaaaaaaaaaaataggatcatggcccttttaaagatctgaatcttctctgttattttcctgatgaatcaccatcccatatcttcttagtcctggccagtatgtagttgcgctcacatacgtctattctagctctgtagctccacaaaacaagtcttaagtccaaatctttgcctcttcatgtctgatatcaccaactcattcagcttttcttcacttattgacatagtgtcatgtcctatcactctctgctgcttctttaaacagtggacacaaacatattttctaattttcagtgtactcagtgaaacttggcagttcaccatgagtcaggctaggttgaaaggctttctttagggttgaaagtaaacgaaattggaatcacccaaagagaatttccccaaaaaacctcagacccagaagtgtaaaagctacagaaggatagaactcccatgtctacagacagttctgttactttttgttctgtactattttggatgttgccaaaatcaaattcatcctgaaaacaggaagcaagctaatgcatatgccatccatgagattcccacttctgggtcagttcatattccattcaaccttttccttttatccttgtcttcttcagaataagacatttttcctccatattttcatattaaatattaacactttataggttctactttaatatatggacactttacaggttatacataaatatttgctggttgattgatttcgagattcattcattctgtgctcaaatatttgtacctagagacgttacatgttagaaaaagtgagcagcttctttctctaatcatttaggagtccatatttttcttttctttttgttctcccaacatccttatctcttactcagctcttcaatttataattaccaaataatcactgttagagaatcagcccctaagtaactttgattctggccaactgtaataagatccaaccacttaaatctgtacttactcaataggaaggaatgtgacatcaggaagagtcattccagtgacattagtaagactttatggagtacataaaatttgataagaaatcttgagctgattctttgacttgatttagaagttgagaaaagagtatttaaggcacaacagggaaacatgggctatactcagagaagaccctctgcattggccaaaatatcatggattctggaaattccttcttaacagaaaaaaaaggcttccaaataatcaggctgaatgggaagaaaaaggcatagaggaagcctgaggaagtatttacttgcttttcccatctctttataattggaagagaagatgatctgccaaaatataacccagcatgcacagtatggacaggaagcagccctccatgaactttattatcacagaatatgagcattcttattgatccacagctacatcttctattcttgcagcaagggtacatgtcctttgaccctccacaaaagaacaagcaggacatctctattttcctattgagtctgagtccattattagaaaggacttcccagccatcttttctacttggtattaaaattcccttacagattcattgctaagtgccaattctttttttttcttttgagacggagtcttgctctgtcgcccaggctggagtgcagtggcgcaatctcggctcactgcaagctccgcttctcgggttcacgccattctcctgcctcagcctcccgagtagctgggactacagacgcccgccaccgcgcccagctaattttttttgtacttttagtagagacggggtttcaccgtggtctcgatctcctgacctcgtgatccgcccgcctcggcctcccaaagtgccaattctgactctacttaaacatcacctgtatcagggagctcattattccttgaggtcttacatttctttcagcacattttgttccaagctacacgactttaaaacagagccagcctttggggcatatgttctctttggtgccacacaaaacctgtagtacatgatacagtgttgcttcccccctccttttccttccatatatatttgttttgttttgggcattgcattacttttttgaatttttaagaatctctaaaattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattagccgggcgtgttggcgggcgcctgtagtcccaactacttgggaggctgaggcaggagaatcacctgaacccaggaggcagaggttgcagtgagcagagattgcgccactgcactccagcctgggcgacagaacgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgccattctaactggtgtgagatggtatctcatagtggttttgatttgcatttctctgatggccagtgatggtgagcattttttcatgtgtttcttggctgcataaatgtcttcttttgagaagtgtctgttcaatactatgcagccataaaaaatgatgagttcatgtcctttgtagggacatggatgaaattggaaatcatcattctcagtaaactatctcaaggacaaaaaaccaaacaccacatgttctcactcacaggtgggaattgaacaatgagaacacatggacacaggaaggggaacatcacactctggggactgttgtggggtggagggaggagggagggatagcattaggagatatacctaatgctaaatgacgagttaatgggtgcagcacaccagcatggcacatgtatacatatgtaactaacctgcacattgtgcacatgtaccctaaaacttaaagtataataataatgaaataaaattaaaaaaaaaaaagaaaagtgcctcacctccctgtgaggcttgatgaatattgtggccagtgagtggaaaatgattcttgtcgaatagacagagtattcccaccccaggaatggattaatagaagacacaatttgagcacttctcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 869 - DNA, 2267 bp, Homo sapiens
cttgtttggaattaaacttctagcaatcatttacctttatggttctcttaacttcaggtcacactgttgtttagtcaatgtgagaatctttcagatgttctgcactttgcaaaaggatattcacagccaatgtgtgcggcagtgaaggacacttgttgattccttatttattgtctgctgttccagggaccggggactagaggtgaataaagccttgtttgggctgtctaggatgttgtgatcgacacaggaaacagacatgaaagccaaattggcgcagtgggtgaagtattgtaatactggtctctgtttatgatatatggaagaagtttcctagtagcagggtgggtgagagagtccatcatcattgcagattggtgcctctgtggacatgcaggtatattaggccagaggtggggagtgggagagagagggagagagagagcacgacaaagagagagagagagagtgagcaagagagagggagggagagagacagagagagagagagagagagagagagagtgagcaagagagagggagggagagagacagagagagagagagagagagaggttttgagagcattgatatggggtctacatattccccccggcccccattccctattatcatagaagcatgctgccctccaaggcttttgaatttgccaccgtgaagagcatgcatggaatcttcggctgtggccttgcattgccccctgtcttcgcagcggagcttctttatctgacccgtgcatgtgcctctgatgagcagcccttcatcacagctctgcggcctcctcctaggcccccgccttcagctctccagttcatttcccgccttgttcccattgccacctgcgggcttggagggccacctgacattctgtcctttgggtcccctgtgactccagagctccttcccttctggggcgcccacatctgcgacacgcttgtttgcccagtgcattttctacacttagagttcctctcgtgctctcatatttccatttaaagccctctcgagaggtctgtctcctgccagcagcattccttctagtttactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttcccctctccccctgagtgagcctttcttcctcttcctcctctttcattcagcctcatcctgccttgggtccatttgacagataatggcaccttgaggccttgtcttttgcatggcatctgtgcctgactggtcagaaattacttgtgaagcaacatagggggttgttggttgggtccacttttaggatgaagtcagaagggatcgtgagtgatgcttggccaataagaatgtattgatttgatttactaattaatttcatttccagacaccaatatatgcatagccttgtttgaagaaaattaaggagaaccattttgtaaatggcaatgagtgtaagacacttaactatcttcctgctctccctggcgtgggcttccgcgctccctgactctgcttttatttaaggtgtctgggaaggcatttgtccttcggcttcccagctggcttcttgccttctcactcactgcctcccgtagcctgtgggcagaatccctcaccgtgcccaccttgccctgctctcgtctgacctcacctctgtttccaggatttgctatggctgtcccctgccagtcatgctctgtgcttgctactctgagtgtgtccctggtcccactctcttgcagcctctgtgtcttagcacatgctgccctgatggcccaagggcccttcccctttgtttctgtctggggaatgttctgtctcctctttcttgaacctccttatattccctcaagaagacttaaggcaaaaacaaacctgaacttactatgtgtggtatttttgtgttataagtgtaggacctagtcatagtaacacatttcaaaaatatggaaccgtataaagaaaatgagcatcactcataaatcactatttagacacaagcattgtttacgtttctaatattctttctttagtggtgcttttcatgattttatgtgcatttgcattttactgactaaatattactatataaacattttcatatcttgccacttcacctaacaatacagcacaagcagcttctcatggcattaagaattgttt

SEQ ID NO: 870 - DNA, 7253 bp, Homo sapiens
ctcccaggccctctagggggatggtcaggcttctgcagagatggggaggatcctttcctggtaaggggagagggacgggctaggagccaagcggaaggaccccgtgttcaaggcccttcaagggacgggacaggcgaggaatctctttgagtcttttgaattgttttatcagtcaggcctgggaagtactccgcctccacaaactctgttttcctgaaaggggtcgggggggggaccccaacatctcctgccacaggctatgatgggcatggtggctaagagcaacaggccgcgtggtgaggctggctttttgtggctctgccctgccattccccgaggcatccccatgccagtgaacagagctgcgggttcccagctgcacagatgaatgcacgaacaaaacataggtccatacaaaggaagtcattgcattgatccagattcgacctgggattgtcgcataaaacagggctgataaaaaccgtcgtgttttcaccctggaaacagagactcagcctccccctctttgcttgaggcattcagcaaaggtttgtccttgagtggctgtggatgctcaaggacttacgatttctgactttataaagtttagggtgaaaacaaaaaacaaaataaggagaccattgttttaaagtggccgttgtagctaattatctcaagaaagcaaacaggctggtactgaaagttacacaggcgggcggctccctgggagggttgcccagctctccttttctgagacctgagcagggagcagccagaggagcttgaagggatggtgttcagggcatgggaacaggctgcacacatcttcacggagtacggtgcttgtccagtttgagaagggaaagaaacgggagcagagggctgatgagaaggcagcagatggatagtgcgggattgaaaaggggatccatttgaagactggccaccattatttattttcatcatctgattgctgttgctccattgagatcgatgcgtggagaacaagttggggagtggaacaaatggcagggaggggagagaagtgagtgaacatgaccctggtccagcctcataggacagagcgtggtcatgaagtccacagaggaggacaggtagggaggaatcatggcatggccaggttgtagggcaagaggcagagaggagagaggattgtggaggatgcctgcggagtgccgactgtcagtcgaggctggtcctttatttatttattttttttttttgagacggagtctcgctcttgcccaggctggagtgcagtggcgcgatctcggctcactgcaagctccgcctcccgggttcatgccattctctcgcctcagcctcccaagtactgggactacaggtgcccgctaccatgcctggctaatttttttgtttttaatagagacagggtttcacgtgttagccaggatggtcttgatctcctgaactcatgatccgcccacctcggcctcccaaagtgctgggattgcaggcatcagccactgtgcctggccaaggctggtcctttcttttatggcgatgggtgtttgaaagttgcacataccaaaataaactcactatttgttgacccaaagtaaaaccctgagggtatgaaagggaagggctcatgcttacatggctgagataaaagctgtctcaggaagctgggtgtggtggctcacccctgtaatcccagcactttgggaggccaaggttggaggatcccctgaggccaggaattgaagactagcctgagtgatatagcaagaccccatctatatttttaaaaagggttggctgtctcgggacttttcgaaatagccctgcaagacattcctgttttggaatcacaacaatttagataagatgcttttgaaagaacacctgcctaggcacagcgtctccaccaatgaactgatgccaactgtggttttgagtcttcataaccggtgaactgtttgcaagcagcttatttaaatctctttttttgccaatacaaccttccctttgccctcccctcttgagatgcatatatggcttgccatagctgagcatcttaggttataatgctttttctcttttttaatttttttttgtaaatttatatttatttttatatttatttattttttgagacagggtcttgctttgtcacccaggctggagtgtagtgcataatcgtagttcaccactgcctccaactctcgggctcaagcagtcctcccacctcagcctcctgagtagctaagacaacaggcatgcaccaccatgcccagctaatttatgtatttactttattaaaaattttttttttttggtagagagagtctcactgtgtttcccaggctgggcttgaactccaggcctcaagtgttgctcccaactcgacttcccaaagtgctgggattacaggcatgagccaccatgcccagcgtataattttgtattctaattcctgaataaattcaacaaatttggaggtgttttttgtctgatggttccttttggtcgacaactggaatgggagaggaacagtgtgagggcaaacatcaagtgctttgctgagctccgggtgctttttttggataagacacagaaaatacaataagatgtctgtaatgtttgatttttttccaggtttcttgaggtataattgacaaataaaaattgtatggattcaaggtgtacaattcatatacattgatccacatataccttgtttgatgattaatcaaattagttaacacatctttcaccccagcagtcaatgtgtgtgtgctctgttagcaaatttcaattaataatatagcattattaactatagttactatgctgtatattagagtctcaggatttaccatcttataactaaaattttgtagcctttgaccaacatctctcattcctcccacccacagcccctgggaactaccattctactctgcctctatgagttccactttttgtgtttcttttttccctttcctttaattttttttgtatttgttatattaccaaaccatgtcaaaagagttccactttttagattccacatattattagctcgtacagtatttgtctttctgcatctggcttatttcacttaacataatttcctccaggttcattcgtattgttgcaaatggcaagattcccttcttttttatgactgatgatgtctgtctgcaatatttgaaaaaaaaatgcagatcacgtgaatgattgtctaatgtaattctattcatgtaaaattgtgtatgaccataacagtcactcattcattgcttcgagttctttacaatcggatgccatattcctggggctctgctaggcctgaaatggggagtaggagttacaaggttcctgggatatcagtaattcatatttgtgaatgtcttagataagtgggctaacatgtacagaaaatggtcactaaaatgataacactgtttgttataaaatacttttctgtattctcttgaactttttttttttatcatttattagactgcttcagctgccataacaaaatatcacagactggatggattaaacaacaaaaatttatttctcacagttctggaggctgggaagtccaagatcaaggtgtcagcaaggtgggtgtcattctgaggcatcttctcttagcttataggctgaggccattttgcgttgtgctcacgtgacccctttgtgcgcatgtgtggagagagagcatgggtgcttcttcttataaggatgctgaaagttatgagaacccgacccttgtgacttcacttaatcttaattacttccttagaggccccatctccatatacagccacaatggggattagggcttcaacatatgaatttgtggtggggggacgcaaacactcagttcataaacatatgatttttttttccttgatcggcaatgaaaatagaggtatcttcattttggaaagtgagagtcaacctgtgctgaattagagtgatgacaagagatactttaagactgcaatgagggaagcaagggatggggacgcatttgacagtctgttctgctgtgctcctggaagtgagagaggctgagtcgggactaacctttgcacggatgagatagagaactgagagagaaaagtatgtatttttctatgaccacctaaaataaacctggagttgaagggaccagcactctcaacctaaccattctgggaataaaaatcatagagacctcgctgattaatggaaacaatttgcctttcgattttctaagcaggtgaatgcaaggagtttgtgaactttactgctgttttcgtgtttttttaggtgaagacactgacagtaagaaaaggcaaaccacaggtccaagacaaagtggtcaagtcaagaaggaactcaggctgtgtagtcctggtgcaaggctccttgcccccagcgtggggtcacactggctggctgtgctcccacgacacttagtgcatactgggctcctgacttaataacacgtgtttgaaatggcccctgattcccaatctgctgcaggattctgcagatgcgcaacaggccacagtggaaggtcttggagagaattcagagtggcttgcctacgttcccatgaccgtttgtcctaatgggagaatcaccattttggaaaattcttttggaggccaggcgcggtggctcatgcctgtaatttcagcactttgggaggctgaggcaggcagatcacctgaggtcagaagttcgagaccagcctgggcaacatagtgaaaccccatctctactaaaaatacaaaacttagcctggcatggtggtgcacacctgtagtcccagctacccgggaggctgaggcaagagaatcgcttgaacctgggaggcagagattgcagtgagccaagattgcaccactgcactccagtctgggcaacagagtgagactctgtcttaaaaaaaaattcttttggggctagctgtgaatgagctcagagggaaaggcaggagccttcaggtagggagcagcatgattccaccccagattcaggcctcctgggtgtacagagggcaggaggatcctccccaggtatgtgagaggaagggaagatgaggtgtttgggtcagtgaacacactagaaatccaggtgctcactgatggattgtgcttggcatctctgttctgccaatccagcctcaaagcaactttggaagaggatttatgcgcttcacacgcttccagcttgggccagagcatctgcacactcccctgggtataggcctccagggcttggagcaacggaagagctaagaattgtcagtgctcaggaggcagattttcagggaggatcctcttgcatctcaggacatggaaagggctaacagagccttaagtgtcctgtcccagtgctggggtctcagaaggcagctctggggcatctccaccatggtctgacttctgctgcttgaaaccattctccctcacggcacaggcaagagtcctcaaggaagagcacctgggcacctgggttgactcttcctctctccaggtggagagaaccagtagagtttacctggggtcatgctctgagttaatccccctctgcatttctttctcttctcaggggcctgggctcagccttgactcagccttcctcagtgtctgggacttggggtaaacagtcaccatcttctgcactggaagcagcagtgacattgagggttctaaccatatctcttcgtacctacagtgcccaggaactggccccacactcctcatttattatgtccattctcaacccttagggggtcccagcttgattttcagtctctaggtctggcaacacggccttcctggccgtctttggcctctagcctgaagatgggcctgacagtcactgtttgttctgggacaaccatagcatttttacccacatgtgctccaagtccacggggaacagagaccaaatctgccatgagtgaccagtgtcacagggcttcacaccagtcaggcagtcagatggtggtgtttgctttcatttctgctcatcatcccaagggggtggacgcttcaggaatgggaccctatgcaactctcattgctctttataatgatgtgggaaagagaaaccatctcccaggggacttggctttgcaaaaatgaaaataaaagctccctcctccctctgtgcagtgaatggcctctgaatgcagacttggtctccctcttcagtggcaaggttggaggaagaacaacagcttcttattgcactgagacaactcaggggccacctcatttgaagatgtgcatcagtgtgagcccaggtattcctgtactcaatgatcgaggtctctctccttaccttgtctccacctggatctgaccaaagtgactgagatgatccaggttctagttttctcttgctgtgtaacaaatttctgcaaacctagcaccttaaaataacacccatttatgatctcccagttttcctggatcaggagtctgggatcagcttagctgagtcatctgttcagggtcttcccaacctgaaatcagggcattagcttggctgtgttttcatctggaggctcaactgaggaagattctgtttccaaacttactggcagaactcacttccttgctgctatatgactgaagccaaggttttggggggctatttgccgtcagtgcccgaagctcctagagttcctagaggtcacccatagctcttttgccatttaatgtaacctaatgaaaagagagatattccatcacctttgccatatttattggttagaagcaaatcacaggttcttcttgaattcaagtgaagagattgtgcaagggtatgactcatttggggtcaccatagggtacatcctcagtaattgtgtgcagtcaggactaggggaggagattctaattatacagagaagacttgtgccttctattcagaagttaagaagacatcctttactttttaagacactctgtcattttattcattgatttttagtggtgttctagaaagcagattttccaagcgtaaagcacaataatgaaatggcagagctgatgacagttcagatgctattagatgggtgtgcagatctaggtttagagccaagggatggagtagtgtctcttggtctccactgtggagaggccccttgggaaaacccaccacccccatttctcctcactccctgcctggacccatggtctctgcttggtctggcctatgctattaaaaatatacttcaatgatga

SEQ ID NO: 871 - DNA, 728 bp, Homo sapiens
ggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctg

SEQ ID NO: 872 - DNA, 24863 bp, Homo sapiens
cgcacagcggcggcgcaggcgcggagaggggcacagcggcggcgcaggcgcggagaggcgcacagcgcggcacagcgaggcgccggcccagactccactccccagctgtgaaagggtaagaactgagggtggctgagactcggggttgttcagggcggggtgggctctggacccagcaggcccggcacccaggtcagggctccaggggaggccaggtgggcgaaggccaagaaggggccggggctggtcaggaagggctcctggtaaccagagcactttgcgtgagccagcgtgggaggaaggtgggctggatgagctagggaggcgccgggaggggccttggcagaggcgaccccctccgtcagcccccaggccactgaaccctgggtagcgagaaccgacaggggaggctgcatacagaggagtggaggctccccggctttgggggctctgagtagaagcatctagggggtccctcaagaggcccccaaacgcctccccatggtgagaaaagaaagcgcagagaggggcacggctgtgatttcttttattgccccaaatgtacttcatcttggtagatttctattggctttaaaaatgtgtgtgttttgctgttggggagtggggtgttatacggatgtcagattttgctggttgactgttcagatcttttgtaaatccttgctccttttctgcctagtttcactctgtcacttacattagagtgcggtggcacgaacatgactcactgcagccttgacttcctagggtcaagtacttcccctggcttaacctcctgagtagctggtactataggtgtgtgccgccacacctggctaaatttaaaattttttggagagatgaggccttgctatgttgcccaggctcgaactcctggcctcgagctatcctttgtctttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcacatatacccacagctcagaggaggacactgcatgccacacagggtcagatgggcaccgcactctgtagcggagtgagggctgtgggctgaggaagcaggcaggcttgatagtaacaagagcacacaatgaccaatggttcccgagggggaatgcagttggcttgtttgaataaattcatgggctggcagacaggtgaagtgaagcttcttaggctgaggtgcaactgtttggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcagcgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttatagttacataattgcttatgtctgatgtttttattatttgctttttcgtttcctttttctttccctccatcttgatctatttctgtataatgttgttgctcgtatctctttgtatagtcttaaagtgtttgctctggatgttacaatatgtgtattgtaatacagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcctatagtcccatattcatcccttctgcataagaactttctgtagccatttttttgttttgatttttttgttttaattttttgtattgtggaaatgacagaacatatttctgtagccactttttagcatttctaaattgaccagtgacaaattcctatattctcttcctctgagaatgtctttatttctctcttcatttctgaagggtagtttcatgggatatagaatttgcagcgaacagtttttttgtttggttggtttttttgtttggttgttttttttttaaacacttgaaaatgttgtgccacttccttctggcctccatggcatttgagttggcgtgtccctacaggcattctgccatttttggtctttgtttttagttttgaaagtttaattggtgttgctttcttttggtatactttgaggtttgctcagcttcttgaatctgtaagtttatatctttcaccaaatgtgggaagcctcaggaattagttatttgcatgctttcacagctctggtctcctatgggactcagataacataaatgcggggttatcgtcccacaggtccgtgcagctctgttcatttgttttcaggttattttctctctcttgtttagactgggtgaattctgttgatcaggtttcagcttctctgattctctcctctgtcgtctccacttttactcaatagggcccatccagttagtttttttaaaatttctgttactggattttatatttctgtaatttccatttgattcttcagtttctttgctgatgttttcagttctttgattgttgccataggatttgtagttgcttgttgaagcatttttatactgactgttataagtgatgagtcagatggttccaacatctgcctatgtaatttttttatttttgcaggcagtcctcctgtttaggtttagtctgtaggtcttggtctactttgtgggctgtgattccaatggcaatttaatttcagagccttcatggtgttattttggtctctttggcttatatgtatcactgggattctcccaccagtccctgttgttgcccacctgagggaacaggggagccgccctaggctgggccacctgctgcagctaggtgggtggggaatggtggttgtcttggtgtgtggagctggttttcttgttgtggggaagatctcctttgatctgcggggactgagtctgcctgggttgccttctattgctacgttgggagttgggaaactctgggcctgggtcaccttcctattggatgaggtccagggagacacctggccactatgcattccctagtcctagagtccctcagcagcctttttctgtccaccttttggaattctccattgatcctctcctgtctattatttctagagtttgggttacatttcttaggagggtataatgtgttatcttctctagaccagaaatccttagtggtggtttcgggttgtaactgtgctaaagggagaattggcgtatttgtgatgtcgggtctttcttttcaaatgaggacatatcattattcagtatataatatttacaacacctacttccttgggttgaagaatgtggttaaggcaaggaaagtacttaacacagtgcctggtgtggagagcacttacgagtgttggtagtgatgctattccttttgtcctttggtagcctattaaagcttttcttcttttttaaaaaaataaagttccggtgcacttcttgttaggtttattcctattttatccttttttgcttttattgcaaataggagcttcctatcttttataacgtctacctggttctttggcccttacgtgaaaatgttttaatagccttctaaacattgttctctcaaatgagttttaatttgcctctttcttttgttttcctttttttgagacagggtctcactctgtcacccaggctggagttcagtgacgcaattatggctcactgcaacctctgcctcctgggcccccaaagtgctgggtttacaggtgtgggccactgcacccagccttacttgtctgtttcttttaagagtgggaactataattgagcccagagctccaaaaacaaatgaagaaatgaatgagtgaataagctcttcccatgggtttggtgtggtttgggactctactcttaatctaaatgctatgttttatataatctaaaatttcccctaggtgtgttacacgattgtgttgtgttgaacttacattgagactccttttcacatgtgctggttatcagcgtgggacttttccattcactctttgaattattcgtttgggggacacagatagacctctgtgtctttcataaagagtgtccattggccggttgcagtgtctcatgcctgtaatcccagcactttgggaggctgaggagggcagatcacgaggtcaggagttcgagaccagcctggccaatatggtgaaatcccatctctactaaaaatacaaaaattagccaggcctggtggcgggtgcctataatcccagctgctcgggagactgaggcagtagaattgcttgaacctgggaggcagaggttgcagtgagctgagatcgtgccactgcactccagcttgagtgacagagtgagactccgtctccaaaaaaaaaaaaaacaaaaacaaaagagtgtccattatctatactagaaaaattgagattgggattttgacatgaagtgcggaaatgtggattgggtccatttagtttacctaaacagatgatgaaatactaactgttttacgaagcattccctagtgcaaagttttgcctgtgtttctagtgatgggaacagtgagaatcagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcaggtatgactttgtcgtagctggctgttcttggtcattgtgttctgagagaggcccgcattgagaaatgcaaatcttacttgtgatgtgtgaagattgcagactggatggatagattccttcctaaagtgtggggatgtggggaccaaagagaagctttcttatttacttgttaagttttggactacagttactaccgtttcttgccatagtcatttgccaagtccactgtgatttttcactcacagaagtcttagcttctcagacttacattcaaccattgccatcattctcctctttttaaatttaagtgtcatttaaaagaatgaaatccctgttctccctaatatttctttagaacagggtctgggagcatctgggtgagggacatgtctgttatttttattctagtttgtgttcccagccagcttaaggaatagcagctagttgtaatgcagatgtaacaatttcctgtagcagtaccatgttattcagagacaaaggttatgttgtgttttgttttgttttattgataatgataacagatttttgctaagatttttgtttaaatagaactttaaaaaatctaatgtttaaagaaaagaccttcataaacatacacaaaattttttcttctggaaatttaagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctctcagccccttgtcaagactatcacatagtgtaggaatccctgactttctttgggtccctgcttcctatcctgcttctgtgcctttcacttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagcgatctgagatagtgtgttcatttcagtgcaagccaatgctgcctattccgatcgctgctccctgatttgaatggcaggtgatcagtggcccgtgtggcttatggacacaccagagctcccaggggaagtgctctgaaaacatcctggtcagagttcagaaggacatgtggagtataaggtcagatgcggagataagggagatggtgtggccctcctgcccaggggtgctgagcaggttgctggaggcggtgatctcactctgaaggagacagacacagaaacgtatgtacagttgatggtgagcatctgagttgcgtcttgttagtgaggccaggagtgcctgtgtaagctggaacagattaggtatatgatttgtgaaacggagtttcatcctacgtcttcatctagtcaaaggactgtttcctgattaggcattagcttagtggttgctagtctgtgttgacctttgaaaggcatgactaggctaactctgaagttgttgcttcacaccatttacaatttaaaattacctagagccttgtgggccattggaaaagactgaatgtttcactctgaaatgggagtccttggagggttttgaccagagaagagacattcaggtaatcagatcactctgccaagagatcagtccagtggcacaaaccagagggctggcagtggagatgagacagagtcaaacccggattgagtttatttggaagctgggtcagtaggatttcctggtggactgaatgtggggtgtgtaagaggaaatgagggtggcgactggaagttcctggaagggtgggttgttgcaggttagataggaaaccgtctgcagatgcagttttgggaagatgatgtttggttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcatgcaggcacgcaggagtccagttgtacacggaggcgaagcactgttcagatcccgctgcagtgttaactacggtaaaggcagagttgaccactggaggagtccttcagcgtggaggccttcagcgatcttggcaagcaccaattttcgtggatgtaggagaatgggagcagaggaactggaggctgcaactgcggaaaacttttgtggggttttgctgcagagagaagcagagaaatgaagcagttgttggtggaagaaatggaatcaaaaggttttgagatagagaacagagggaagagctgttggaataaagtccaggaagagtggatggtgtctagtgagcaagtgatgtgtggccctgagtagaggcacgtacaaatcacctgtgcctgagctgcccttagaactttctgtgatcatggagatgcacgtctgtgcttcccaatattgtaacattggccgcaggttgatatggaccacttccagtgtgactagtgtgattgaggaactgcattttaaatattatgtaattgtaattaattttaatttaaatagccacacgtagctcctctataggccaggtcagagctctgataaggctggatatgggaggaaaccctggtagagggttgactgtagaggttcttttggttttggagtgaatcaggaaacagccatcagctgagtgaaggtgagggtggtggtgggtgtttgaagacaagggaaaagtgtgaaagaattgtttggagaggaaggaaagaagatgtggactggggatgtttccaatgttcgagcacgcagggctccacagttatctacatttgctgtcccttggagcaggagagaagaaaacggttgggacatattctgagcagactgtagaggtaaaatacgtagtttttttttgttttttgagatggaatctcgctctattgcccaggctggagtgcagtggcacgatcttgactcactgcaacctccatctcccaggttcaagcgattctctcacctctgcctcctgagtagttgggactacaggcacgcaccaccacacccagctgattttggtatttttagtagagccagggtttcaccatgttggcgaggctggtttcaaactcctgacctcatgtgatctgcccgccttggcctcccaaagtgctgggattacaggcatgagccactgtacctggccaaatatgtagtatttttaataggataaagcctacataattctgtccacagttcctttacttagaaattgctcatttgttcatgttaatgctatgtttattacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtcttaagtagtgttcagggcagggtgttaccattcatgcttgacttctagccagtgtgacgagaggctggagtcaggtctccggagagttgagcagctccagccttagatctcccagtcttatgcggtatgcccattcgccttgtgtctgcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatattaaagtaaattacctcttttcagatattgtcttcatgcaaacttggtatcctgtttccatcccagccttctgtaacccagtaacatctttgttgaaaccagtgggtgagaaagacacctggtcaggaacgcggaccacgggccaactcaggcttgcccatggtgtcagactaaaggcaaacaaggactctctgtataaggtactggtcgtgtgtgtgttagtggagatgaagcctgtgctctacagacagggagtcacacagacacttttctataatttcttacgtactttgaatgttcaagtataaagtctaacattaaatttgattgaacaattgtatgtttgtgggatattttggagtggaacaccaaaaaatggtaatagtggttctttctggattgaagacaaacttttcttttttaaaataaattttattttatatatttgaggttgacaacatgatcttaaaggatacatatagatagtaaactggttactatagtgaagcagattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctattggtcatttcctatttggcccatttttcaactgggttgtttttctgctattaagttgtaagagttctttactgatttttggatattaacactttatcacatatgtggtttgcaaatatttcttccagtctgttggttcccctttcattttgttggttgttcctttgctgtgcagaggctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgcgaaaatcctattattgaagagactatcttttttaccattgtgttgtcttgtttgcccttgtcaaaaattagttgacagtatatgtttggatttatttcaaaggtctctgttctgttccattggtctatttttttgtttttatgccagcaccatactgttttgattactatagctttgtaatacaattttaaatcaagaggtgtgatgcctccaactttttctttcacagtaatccgttggctgtttgggattttttgtggttccataagagtttcaggattgttttttcttttcttttttttttttttgaggcgaagtctcactctgtcgcccaagctggagtgcagtggcataatctcggctcacggaaacctctgcctcctggattcaagcaattcttctgcctcagcctcccaggtagctgggactacaggcacatgccactatgcccggccaatttttgtagttttagtagagacagggtttcactctgttggccgggctggtctccaactcctgacctcgtgatccacccgctgcggtctcccaaagtgctggaattacaggcgtgagccactgtgcctggccaggattgttttattcggttctgtgaagaatgccatcagaactttgatgaggattgtgttaaatctgtatatttgctttgggtagcatgaacattttaacaatattaattctcctgatccataaacacgggatgtcttttcattcgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctacgttatttgtatatagaaatgcaactgatttttatatgttgagtttataccttgcagcttaactgaattgatttagtagttctcacagttttttgtggaatctttggagtttttttacgtaaaggatcttgtcatctgcaaatagagataattttacttatttaatttagttgcctttttttcctcatctgattgctcttgcaagtattctattgaataaaagtgatgaggctggccatccctatcttgtactcaatcttagtggaaaagctttagttgttccccactaactatgattagactgtgggtttttcataaatggtctttattgtgttgaggaactttccttctatacataaactattaagagttttatcaagaaacgttgctgaactttgttaaatgcttttactgcatcaattgaggtgaccatatcgttttatctttcattttgttaatgtgatatatcacattgattgatttacatattttaaatcagccttgcatgccagggataaatcccacttaaacacgatgtataatgtttttgatatgttgttgaattctatttgctaaaatttttttaggatgtttgcatcagtgtttaatttattggagaagttgacctgtagtttttgtttgtttggtgtgtgtgtgtgtgtgtgtgtgtgtgtgtgtgtgttttggtttggcttaggtattaaggtgatactggcctggtaaaatgtgtttggaattatttcctctcgctctgttttttcgaagagtttaagaagtaaactcccaggggatgggagtgactctggacatgggagtgacatgatagtgactctggaccctgcagtggtgggacacagcagcatctctgtctctgtgaggccaggcgcagcatcagcaaggaccccagaatggtggagcactactgtggcttgggccctcgggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagcgcttcagctctcatgcagtggggggtgtgactgctcagactggccaaggcactgattccctggaaagcagggcaccaagtcagctcaggctccaaggggcagggcgcaatggcagctgggaggggaggggcacagcagcatggccctgcaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcatacacctgtttccccttccactttccctatgagatgaagcagcacaagaccctcgccagttgtgctgcccaatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggcagctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttatccctgcagggagacatcccctctgcttcaggctgatccctctgggggaatgggtggtgggggccagatgtttccttccctcctttatgtgaccgtcctggttttctgtgctctgctggatttctgctactccttgatgcactctggggctctcttttagtgactttcatcaaaatatagatgtttgctgctttggctgtctttgtcaggggatgagtgcaaggggctattgatcagccccttgctggcatcactccctcttaaacttttcactgggtactcttttgaactattttttcccccaccgtatacatgtattttttaaacgttaatgtgctaatttctactgaagcaatgtggatttttctgaaagttttaatgttttaataagctttttattgaaatgttaatgtccacacagaagagtgcccgaatcataagtgtgcatctagatgaactgtagcacaccaggctgccacgccctggaccaagcagtagcctcgccctgtggcctctcccaggcactgctgccccaacccacagaatagctactttcccagttcctgatgtagatttgttctgcctggttttgacttctataaaatacagcacattctgtttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcacacgcacttctgctggaggatccctgggtggggtggagactccagggcacctgtgctctgcttcagtatggagtagttggagtgtattgcttagaacaaaagagatgagacactaacactgtgtgtatattctaaatcatatatcagtgaagaaatgtgatgtttgcaacatcttctctggggatgctaaccccctaagtcattattaccatgcatgtaagcacctcacctagatctgcactccatctagcagtgagaaattccaccataatctacacaccataatatcatcaatgtgtctagaagtcagatcctctatgtgtgaaccaagacaatgcctggcaaacaagacagctgggctctcaggtctctgcaccatggggaggtgtgtaaggccattcttgaattactataaagaaatctctgagactggatgatttacaaagaaatttacaaagaaatgttgaattgactcacagttctgtgggctgtacaggaagcttggtgctggcatctgctccttttctgggatgcctcaaggagtttttactcacggcagaagatgaagtaggagcaggcatctcacatggcagaacaggagcaggatagagagtgggtaggaaaggtgtcacaaatttgaacaaccaaatcccatgaaaactcactatcataaggtgaaaaccaacccaagaaggatactctctcatgacccaagtacctcccacaaggtcccacttccaaccttgtgaattacatttcaacatgagatttagtttagcatccaaactataccattattcccctggtctctaaagtctcatgttcttctcacatggcaaaatacaataatgtcttcctaacaatccccaaaactcttaactcattccagcatcaactcagtcgaagtccacagttcagagtctcatttgagttaaggcaagtccctttcacctataggccagtaaaataaaaaacaagttatttacttccaaaatacactggtagtacagacattgggtaaatattcccattccaagagagaaaaaactgccataaaaaaagggctacagatgtcatggaagtttgaaaccccgcagggcattcattaaatgttaaagctccaaaataatctttttttgactccgtctcccacatccagggcacactgatgtaaagggcaagctaccaaggctgagggcagttctacccatttggctacgcagggttcggcccctgtggctactctcataggctgttaagtgcctgcagcttttccaggtgtaggatacaatctgccagtagatctaccattctggaatacagaggacagtgacctccttcccacacctccactaggcagtgccccagtggggactcggtctggggcctccaaccccacatttcccctccacactgacctagtagaggttctgtgggagggttctgcccccacaacaggcttctgccttagcacccaggcttttccatacatcctctgaaatctaggtggaggttgttgaggctccagcactcttgcattctgtactcctgcaggtttaacaccacatggaagcttccaaggcttaacatggcttttgctccccaaaactgtggcatagcattatctggagcctcttgagccaaggctggagctgaatcagccatgaggttgcacaggactgtggggccctaggccagacccagcaagccattcagttcacctaggcctcaggacctgtaatgtgagaggctgcctcagagatatctgaaatgcctttgaggtctttttcccattgtcttggctatcaacacttggctcctctttagttacgcaaatacctctagcaagtgattgtttcgcagcccacttggattcttttcaggaagaggggatgttattttctgccacatagtcaagctgaaaatttttcaatcttctatgctctgctttccttttaaatataaattccaaattaaagtcatttctttgatctcacatctgagtataggctgtagacacagccaggccacctcttgaactctttctgcctagaaatttcttctgccagatactctaaatgattgttctgaagttccaacttccacagattcctagaacatgaatagaattcagccaaactctttcctaaggcataacatgggagatacttgccccagttcccaataagttactcactttccgtctgagatgttgacagcctatgcttcattgttcctaacaccatcagcattttgatcacaaccatttaaccagtctctataaagtctgaagcattttctaatcttcctgttgtgaacccccaaaattggacacaagtctcagttaactcagaaagcttattttgccaaggttgaggaggcacatctgtgacacagcctcaggagatcctgatgacatgtgtccaagatggtaggggtacagcttggttttatgcattttaggcagacatgagacatcaatcaacatgtgtaagatgtacatcagttcagtctggaaaggtggaacagctccaggtgaaggcaggacaacttgaagtggggaaggggcttccagtcttagatagataagagacacatggttgcattcttttgagcttctgatgagcctctccaaaaggaggcaatcagatatgtgtttctctcagtgagcagaggggagactttcaatagactgggaggcaggtttgctctaagcagttcccaggttgagtggggtcccaagatttgttttcctttcacactgtcttctcctgagccccccaaacccttccaacctctggccatgactgagttccacagctgcttttgtactatcaggtatcttttagccatactttatttaccaattatctgtgttaggacattgttgcattgctacaaagaaatttgttgggaaatttacaaacaaaagaggttgaattggcttatggttctgcaggctgtacaagagtcatggtgcctccatttgcttggcttctgaggacacctcaaggggattttacttggtggaacatgaagtgggagcagacatctctcatggcagggtgggagcaagaaagagagtaaggcaggaggttccacacatctaaacaatcagatcttgcaagaactcactcactgtcatgaggacagcaccaagcctcgcggaatccgcttcaatgacccaaccacctcccaccaggtgccacatgcaacattggggattacgtttcaacaggagattgagagaggacacacatccacactatatcaggaggtgtgtgccttgcaaccatcaggggatgctgcaggactgccctatggtccctacacagctgcttagtaagaaccattcactccaaggaacctgtgccctgtgctcaatgatggggactcaggagctgtgtcctctctggcctggcagagtcccctaagcagagacctgtgtatggtctcggcaggtgcttcctcccagggccctcccgagggggaaaccaaaccttcctcctcctcagtctggagtgtgagctaagcttcagctccagggctcagggaggggctgggcagtccttggatggaaacatatttgcatgagcagcccctcctctggcagaggatggagaagaagaggagacctggggcagctcaggcccactgttagggctcaggggctgtgtccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaagaagacctgagtaaatgcacagataatccttttttttttttttttttttttgaggcagagtttcactcttgttgcccaggctggagtgcaatggcatgatcttggatctcggctcaccacaacctccacctcctgggttcaagcgattctcctgcctcagcctcccgagtagctgggattacaggcatgtgccaccacgcctggctaatttttgtatttttagtagagatggggtttctccatgttggtcaggctggtctcgaacacctgatctccggtgatctgcccgcctcggcctcctgaagtgctgggattactggcgtgagccaatgcgcccagcccagataacccttttttttttttttttttttgagcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactgtgttgtcacctgcagtgtacacctgaggtgacatggttctgaacatcactttccccattgaaggcccgagtgacctatcacttgcttctcaaaattcaggaactaggtgactctaggagagtgcacaggaagctttctgcatattctttcaagagatttcgaggtcactgactcttttttcaagacttaaacacaaaatccacatccatcattcttgcgtaaagagaccattcttttttttttgagatggagtctcgctctgttgcccaagctggagtgcagtggcatgatctcggctcactgcaagctctgtcttctgggttcatgcccttctcctgcctcagcctcccaagtagctgggactacaggcacccgccgccatgcccggctaattttttgtattttttagtggagatggggtttcaacatgttggccagaatggtcttgatctcttgacctcgtgatccacccgccttggcctcccaaagtgctgggattacaggtgtgagccactgcacccggcccaagatggggtttcatcatgttgacctggctggtctcaaactcccaacctcaagtgatccactcacttcagcctcccaaagtgctgggatgacaggcgtgagccacagtgcccggcctagtacattgtttaaatggtgcatgtaaaacctcatggtactacaactgcctggtgacagactcaccagagtaaataactatcctgctgttctccaaccacatgggattccccaaacaaagatttgttgagtccaagatgcatcatgccagaactcttgcagtcatacacataatttgtttcattttaataaatacggttatcttttttcttcagtttattgtttttaatgtatcatcttctaggtttcattacacatcaaagatgaataatttctctcatctttaggacatgctgaaaacactcattagtgattttgaacagtattatttcctaaacatcctagttggaatggttgatcctaaaagctaccatgtgtcaggctcacctgagtgcagactgtggtctaaacaagctaaagttttaattcttccatcttcaaatacggagcatatttgcttgttttgctctttagcaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacaggtgaggaaatgagtccatggggctggtcagtgctctcgatttcattctgccataacaggactttgtgtagtcaccacctgagtcctatacagtgaacagccaaggagacatggacagattcacccctgaggaacccagtagaatgtgaagtctgccctgaggtcacgaagaaaagactcggggggctgcctggcctggccctgatggagggggccatggacagaacaacggggaggcaggggtgtctctgagaggctctggtcaccttgtcatacaatggtggtgtacaatgtcgcaccatggacactagggggcgcctgcgcaccattcctgagaagactgggtgtgatgagagcaggaccagcgccacctgtcctgcttggtgccctatgcttagggctcacagatgtcaactctccaccccctgggaccacacagccccacccctggcactctctgacatcctcaggcagaggagcttgacccagggcccagggtgggatcagaaagctggagggtctgatttgcatggatggaccctccttctctcagagtataaagaggggcagggagagacttggggaagctctgcttcagctgtgagcgcagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctg

SEQ ID NO: 873 - DNA, 11575 bp, Homo sapiens
gtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacaaacctgttgacaggtcacgcctgggaagcgggtggggtgtcccggagcggtgctgaggcgctgcaggcccggcttctggctgcgggggagctgtaccctgaagcctcgccggaactcg

SEQ ID NO: 874 - DNA, 6554 bp, Homo sapiens
tttgtgtgattccatttatttaaagttcataaacaagaaaaacctctgaggtcagaataagggatgccttgttgggagcatttgactgggaaagggctcaaagactttggagctacttcttgacaatagggagctgatgagatgtcactgtgaaaaacaacctgacagttgatgacattgcttgctagcatctacagccacaatgcacatatggcctagcctcacttctgcctttcggaactcctggaagtcagtcgaacatattttcagctagaatccttgctgcaagggagtctggaatctctagtgttcatagccgtcttctttttagtttttacaggagaagactgagggtcagtgttgctaacaataacggaagccataccacttgatcctggctgaactgaagtttgaataataacttttgtttcacgagggaacccttgcagttgctccggctttttaaatgtttgatggtccttggttttgtgctctatttcctccttcaacgtcaaaaactgtagccggcacttggaacactgaaggaccctccttctgctgtgcctccaacaatgattcatgtatggtattgcagttttgaaaagtttgagacaaaacagacaaagcaaattctttgtgttttcatggcacgttctaaaatgtgtttccacatcagcaaagaccgacgatctgtaatggcaaacctggcacacgtagggcatttcgccaggcttatgatggtccttcatgtgttgtaagaggacctgatctgtttcaaatgacaattcacagattttacagacagcagagggccccatggcgatgtgtacactatcaatgtgacactgtagctggaagggagtgggaaactgccggtggcagtgctggcaggtggtgtggtcttcccagctgtcgttcctctgcttctcaaattccaaatgatgcttcatgtgattcataaacttaatattttttagaactttcacgcagctgaggcatttaaaggtggtgtgagtcttctgttccggctgcccatctcctttatgctgtccatagtaaaagttgctaagtaacacgatgggattttctttcttgggatcaaaggtcttgttttgacttgctagacttgaaatgtctgtcattgccaggccagactcatttgctctctctggatctgtaagattgaaatgtgcctttccattagcatcaggccaaggaaatgttactccattctgaacatggtttgatgagttgcagatcccctgtgagggtgtatttgtgcttattgtagaagacatatctgaagggaccacagctaaagaaggtacccctgggattccatccctgagtttaacccttttggaatctctgctgtttatatctgaagtggaaagtcgctttgaatcaggagaactctcatttctgcctcctccagagaccatagctccaactagacactgagtccctggggggagcgaatctgagtaattgggagaaacaacttgtggtgagctcattttataaccaggttcagatgaagacttcatagtgacaggactatctgtcgatcgcccctcagacagagaaacgggcatgatggcttttgccatagaggtcacatgatttgcaggctgcgacacgtgagcaggatattgacggaagtggcctttctttcttcttgactttgagcctggggtgactctgttcaaaatgtttgaaacgactggttttgaatttgaaatcatcccgacaaagagaacttcagcatctctatgtacatgctccaccccaacatagatcagatctggatcttcatcatcctcctccctttgtttggattctctcaaattcttctttggtgattccactttcttacacaaaaagatatctcccattttcaatttactttttgcttgaagccactggtctcttcaacttccagagctgtctttttacaaattgccacctaagtgcaaccatgtgacaatagtcaatatttatttcgaaagacaaaatcattactttattgtatcctcccttaaaacactgagataaccatcaacatctctattttacacgtcagaaatgaggcttgaaacattttaaatggcataataatttcaaatttacctgtctctcctcccctggtcttctgcagttgtgaggcaaaggaagcaagatttcaggaggtgcagatggaacatctcagagtgcttgcctctaaattttgcactctagatgcctcactcacctcctcctcatcccacaggtactctctcagatgtctaaggtttctaaccaacttgaacaaaacttctctcaaaaacattctgctcctagcctgggcaacatagcaagaccccatctctacaaaaaaatttaaaaattaaaaaaaattagcttggcatggtggtacacacctgtggtcccagctacttgggaggctgagccaagaggaacacttgagcccaggacttcaaagttatgttcatgccactgcactccagcctgggcaaccaaatgagaccccatcacacaaacacacacacacacaaatcacaacacacacacacacacacacacacacacacaccctttgctgttcctgtaatgttccttttctcagtaaactcagttgctcagtctacaaacttcagagtcatcctttgccagactttctctcatacactacagccaatcaattagcaaagctagtctgctctatcttttaaagatatccagaatctgactactctcttccacatctactgccacctccctgatggaaggtaccatgttctctccctggatcactgcagaagttgccagtcttaaaagttttgtcagatctccccatggtggccccaatgcccctgttaaaatatacaggggagcaagtatattttgctcttaagtcttcaatgactttccatttcattcataggaaataccagcaaactttaaatttctccatggaaccttaggtcatcatcgcccttgctaactcctctgttgctctgatgcagccatcctgagctccgtgaatctggaacacaccaggcctttttctttttcagaacttttgttgttcccggacattgcgtgcctctttccccagattaaccccatctgggctcctggtctgcctcagtcccatggttcctcttcagcaaggcttacctgaccacaatatcaaaaatcacaacctccttaactcatatgttcaaaccctcaatgttatttttcaacttagcatttatcactgcctaccacacaatatgtaaaatatatcttgcaagcccaggagtttgagattacagtgagctgtatcatgtcactgcatccagcctgggtgacagaggaaaggaagactctgtgtcttaaaacaacaacaaaaaatgggacaggtgcagtggctcgtacctgtaatcccaacactttgtaaggccaaggcgggaggattgcttgaggtcaggagctcgagaccagcctgggcaacatagcaagacccatctctacaaaaaatttaaaaatataacttgtttcttttctgtgtttacccactaaactgtatgccacatgagggcagggagttgtgtttcatttactcctcagcttatagagcaatgtctgtcatactgtgcatgctaaatctttgttaaataaatagtagctgttattaatatgatcatttaggtgtaccagaggctctaatccattattccagattctctaagcatttaatgaaatccaaatccaaatgatttaatactgttgtacaagggagaaggtaaacctgtgtgtatgtgtgtgtaaattgaaacaaaagttttgtcaaatactctaataccttcaccttaccgcaagggataggctctgataccttctatgccatattttattgattctaaggtataggcttagatttccattttaacatctctaaatcagattgcatctcatcatagcatctcatcaatataaaatacatttcacaatttgtttttgcagtatatatttttatttcatagtggaatcaaaaatgacatatctcagatccttttgtgaggataagcgtgatgcttgggttttcactcatgtgagatgtgcttccctcaaaccttgttatatcagcatgtttaacatctgatgtaaaaaaaaaaaaaaaaaaaggagagtaatgtatcttttataattgatggcatctttttttttttttttttgagatggagtctcgctctgtcgcccaggctggagtgcagtggcgcgatctcggctcactgcaggctccgccccgcggggttcacgccattctcctgcctcagtctcccgcgtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcatgagccactgtgcccggccaattgatggcatcttatagtcagtgaaaaatcctatttctttttgtaagctgacagcccactaaacttgttttgtagttctctaatggatatcacctacattttggcaaacaatggtttaagacagaaattggaaaattggcccttcccctgtttttgtacagtcaggaagccaagaatgtttcttacatttttaaggtattgttttcttactttttttttattaagatttttttaaacttgtacatttttagatttgggggaataaacacgcaaaaggaagcggggcgcggtggctcacgcctgtaatcccagcacttttgggaggccgaggtgggcggatcacttgagctcaggagttcgagaccagcctggccaacatggtgaaaccccttctctactaaaaatacaaaaattagccaggcatggtagcagatgcctgtagtcccagctactagggaggctgaggcaggagaatctcttgaacctgggaggtggaggttgcagtgagcgaagatcgcaccactgtgctccagcctgggtgacagagtgagactgtctcaaaaaaaaaaaaaaaaagaaaaaaggaatattttgtgatgtgaaaattatataacattcaaaatgtcagtgttcactataaagtgttgtggaacacagccataatcatttttttagtgctgttgtccatggctgctttcacacttctatgacacagttgagtacagtagtacccccttatctttggggcatatgttccaagacccccgaagtggatgcttgaaactgcagatggaaccaaattcaatatatactatattttttcatatatgtacatacctatgatcaagcttaatttataaataggcacagtaagaggttaagcataacaaaataattataacaatatactgtaataaaagatatgtgagatagtgcgtggtggctcatgcctgtaacctcagcactttgggaggctgaggtgggtggatcacctgaggtcaggagtttgagaccagcctggccaacatggtgaaacccatctctactaaaaatacaaaaattatctgggcatagtggcgagcacctgtaatctcagccacttgggaggctgaggcaggagaatcacttgaacccgggaggcgtgggttgcagtgagccgagatcgcgccgtggcactccagcctgggcggccagagtgaaactccgtttcaaaaaaataaattaataaattaaattaaaggtatgtgaatgcaatctctcgctgacaaaatatctttatgtactgtagatcttggcaaccttagcatacgattttgttttctttccttattatgttaaaaactttcccattttcacttaaaggaagcaagcactttacagcttctttttggcatatttcaatcgccagcattgctacccttgtactttggggccattattaagtaccataagggttaattgaacacaagcactgagataccaccaggacagtcactctgataactgcgaccgctcctaagtgactaaggtacagagagcgcagccagccaacagcatggggactcaggacaaagggaggattaccatcccagggcagggctgactcaagagcttatcacactactcagaagggctggcgacttaaaatttatgtattgcctatttctggaattttccaattaatattttggaacctcaggtaactgaaagcacagaaaggaaaaccctggataagggaagactactgtagttggagcagagaattgcaatacctaaaatatttgccatctagtctttcacagaacaagtttgccagctctagttttagaggagcaaaatgaaagatagcaaatttctcagctcaccagttcctaaagttgcgagtgcatccagatgattcagtgcagctcagtatgttccactctgggccacaagggaaagcgaagctggagcttccttgtctccacctccgggagaaatttgtccagagaccggcagcactgcttccgcaggcgaacaacgccgcttgctcttcaaagtcctttct

SEQ ID NO: 875 - DNA, 24735 bp, Homo sapiens
tttcacaaaacattttattactataattgatattttacttataatttttggcaacattaataaaataataaatttcacctgaaagaacaagcgagcaaaatagacaaggaaattcacaaagggcaataacaaaatagtaatcttgacatattcaatatatttgtaaacaaaacaaagtgacattgccttaaaaatatatagaggtatcaatagaaaaacagagaaagctcctgaaagaactcactatattaattttcatttggttgcaggcacagaaattgactcaagctagctcaattctaagacagaagcaaagcccttgatgctgatcgctttccagctttttcatgaaaacctaggaaatttaaatactttgaagaggaagaaaagagtggggagagagtaaagtgcctttaagaggaaaagtagaagtttttttttttttttaaagggagatctcattgtcagtggcattttaagagccttgaagctcaatgaaccaaaggaagtgtcaaacaattaagtgaggtagcaagccatgcaggcctaggggaagggcattctaagaaagacaacagcatgtgcaaagtctttggattgggaagaatgtgatttgcttaaggaatagcaaggccagtgtgtcaaaatagtgcgtcattggggaaaacagtggagaagcatgacagagaatgaaaaagagaggaaggaggtaggcaggggccagatcactggaatctacagttggcaattaatgaccatatgtactccttaagagcatgctttaatgaaactgcaaacaacagtgttgataataccaaccaatcactcaacatacaactaaaacacttcatatttttaccacagaaacagaatacgggaggtaagtatgaaaagtctgtagatctatttatacacagtgggagtatctacctgagacaagaaaaactggcacacacacacccacttgcacacacataccctttcttcaactaaagaaaggattcaggctgtaattttagcaaagtgtcttaacccaagcaacgtaactgaaaagacctagtatagtgttcaaggtgcaaatcaatcaaatgagtgtccggcaaataaatacaacagaatctatggatctagagtcagaaaattttctaaaatgtagataatatactcacaacttctttgttatctgtactgccttctactctaagagggatgctaagctcttaattatctcttcccggatttttgtgaaagcttaggaaatttaactagattgaggagggaagaaaggagtggggagagataaggtacctttaaaaagaaatcaaggaaaaagggagagatttctccagacctatgtctacagccaagatggcggattccttgactggtgaagacaggctgctgggcaccttggtcaggggtggaggaacaaaggatggcaccagaacacaagcagggagacaactccgggagtccacagaggcagccaagactgctgatgttcaggaaccaatactcaaaaggtactccagaatactgtgaaacagcccctggggagagcaagggaaaaagattcacccatagtacagattagataggatagatcagatgaaggacattaactctaagtcttaaaacttattgaattagagagacatttcttgcacactggtgtgtgtcaggtaagacccaaacagcattagtgtcaaaaaactgggaaactatacatttaacagaatagctgcaagctgtaatacattcatgtccaaagcaagacataaagttgcaagcttcacatgttcaattagggtaagatatatatgcacagaaaaatataaagccattatgggtttaaattcagtcagtcaccctgggctatttttgtccactgtacctactgttgttgggacagtcctcattccagcttaacagtgggaaaactaaatttagcccagtccaggaactggacagacaccacttgtttggcccttttcagttaaaactatgggtccagtacagttcaaattatagatattagggcttcttccccttgggaaacttgctttacagctgtggctgagaatatggccagttcattctccactaacggctagccagaagggagaggagagggaatgaatcaaattcacctttagatcacagaacaggaagtcagctagtaccaggcaccattctattaattttattgctatttcacctcaaaccaatgatacatgacggctgtttgatgtctgcaggggcccttcaccaaacaaaaccattttactttgaatggtttggcttccttggatgttttcaggtaggtaaagatactctgaagcagtgttccttttgacctggccccaagactagaatgaatgtgtgcctatccttcaactagaacaaagaaccactgctctccctcaactaacctccgccttcttggtctctgctcacgcagcagcttctctttcaattccacatcctggcttttcagaatcttttcaggttattttatgccagcacagcagaggcacttctgggaattcggcagcaagtgggccagggcataacaaagccattccagtctgactagagttaaccatgaaatgctgaatgcatggaaaaagctgtaaagaaaactaagtatttcaaaaattctatgaattctgtatatagaaaaaagagctttcaagcttaggagtaacatgaaataccaaaacaataaataggtgccaggggcagtgactcacacaacccagcacttggggaggctgaggcaggaggctcccctaaggtcaggagttcgagaccaccctgggcgacataacaagattccatcgctacaaaaaattaaaataaaaaactagctgggtgtggtggctgcgcctgtagtcctagctactctccaaaggctgaggcggaggaatgcttgagcctggaagttcaaggttgcagtgagctaggatcacgccactgcactccagcctgggtaacagtgagaccctgtctctaaagtaaaaaaaaaaaaaattaaaattaaaaaaataaattaatacctttctctctcacacacacacacacaaacaccttttatgtgttaagccagatacagttaacatgaaaaccagatgttttaaaataatacctcaaaattcagatcaaataatatatatcctgaatcttgtttaaaaagtcatatataatccactagtttcactatttttggtgctactgaataatgtatggtttgtattttttgttttatgaggttttttaatttggtttgaaatacttgctttagatttactgaaactagaattaatgggacttttttgaaattttgcttttagacctggggagtgatggttcagagtcagatgtgctcacagttatggatgctacatccactgatcctggctgaagaggttccagtgacacttgaatagtaacttttgtttcaggaggtaatccttctagttgcttaggcttcttaaacatttgatgacactgggtcttgtgctccattttctccttgaaagttaaaaactgtagccggcacttggaacactggtgtgcactctttccccagtggcccctataatgacacatgtatggtgttgctgttttgaaaattttgagacaaaagggacaaagcaaattctttgtgttttcatggcacgttctaaaatgtgtttctacatcagcaaagaccgacgatctataatggcaaacctggcacacatagggcatttcgccaggcttatgatggtccttcatgtgttgtaagaggacctgatctgtttcaaatgacaattcacagattttacagacagtagagggctcctgggcagtgtggacattttcgatgtgacactgtagctggaagggagtgggaaactgccggtggcagtgctggcaggtggtgtggttttcccagctgtcgttcctctgcttctcaaattccaaatgatgcttcacgtgattcataaacttaacattttttagaactttcacgcagctgaggcatttaaaggtggtgtgagtcttctgttccggctgcccttctcctttatgctgtccatagtaaaagtcactaagtaacacaatgggattttctttcttgggatcaaaggtcttgttttgacttgttagactcaaaatgtctgtttttgccaattcattttccctatcaagatttgtatttataggcttgaaatggatattgtcctttggaaaagctgctggaaaaggtgctccattctgaacatggcttaatgaggtatgaacattatttgagggtgtactttgctgagtattcattgtatgaaaggtatctgaagggaacgaagctgaagaatttccttctataattccatccctgagtttagcccttttgggatttatgctgtttacttcgaaagtggaaagttgctttgatacacgaggactttcatttatacctcctactgaaagtgctgtacttactggatgatgcaatgaatctgtgaatgtaatcaaaggagaaggtaattctgaagagttattaggcacaacttgtggtgaactatttctataatcaggtttagacaaaggctcaataataataggactatctgttgatctcgattcaagttgggaagctggcaggacggtcactgcttctgatgtaacggtctcatgacttttaggctgcaatttgcgagcagtatcttttctaaggtgatcatacttttttctccttgaccatgaacccggggtgactctgttcaaaatgtttgaaacgactggttttgaatttgaagtcaccccaacaaagattagctcagcatcttcatttacatgttccacaccaacaaagatgagctcagcatcttcgtcatctacttgtttggtttcttgtatgttcttctgtggttcaggctctttctcttcctcacatgattgttccattttctaatttttttattcctgaatggtggggccacaagtcccaatgcttcctttatataaactgccacctaagtacaaacatacatcagtaagtacaggaaaatgcattaccttatttaattttcctccaaaacattgtttttataaaccactattttacccacaaggacactgagactgaaagaggataaataacagcttaaaacctgtgataaaagatcaggttcctatgaatctagaatcataactttgctgtactgattgtgctctattccattttaaaaaaaaaacctaccagcagctaatcactaggcaaaattatatggaaaagacacacatttttatgagggcatcattgtgcagtgtttagaaacatgggctttggagttgaagagtaagctggaatccttagtctgccacacaccagatgcttcctctttagcaagttttttacttttaaatgtattttgctatcttaaaggcaaaaattcttatttcttagacttacagtaatagctggttttttaaaagcaccacctattcaatggcagcttgatttgtagtggaattggaagaaaattacaataaatgaaaatatctcaattgattcatatatagtaatctcataaacattaatatagaaaagaggtattaaatttatagagttagagtacctacacataaccaacaaacagcatagcacaatgtcaattgccaggcagataatctcatcccaactcatggccttaattataatccattcagtaatgcctcctaaattttcccctccagttctgacttacccactgaacttaaacacaacagtgcttcctcctcaatctcttctccacatagcaagcagattgattgtgttaaacaaagtcagactgtatcattgttcagctcaaaaccctccaacggctttctgattaactgagagtaaaagaccaagtattaccaatgcctagaagactacactaccaaccccacatactgctcctgcagttatctcatactactctccactatccacttcactgtagtcacactaacctccttgctatttattttaattttttaaattaaattttatttttttgagatggagtcccgctctatcacccaggtatatatttcagctcactgcaacctccaccttccaggttcaagtgattcttgtgcctcagcctcctgagaagctgggactacaggcatgcaccaccacacccagctaatttttgtattttcagtagagatcgggtttcaccatgttgaccaggctggtcttgaattccttatctcaggtgatccacgtgccttggcctcccaaagtgctaggattacaggggtgaggaactgcacctggccctccctgctatttcttgaacatactaagctcttttccttgctcaaagcccttgttccttccaatatgaatgatcatttgggtatccgcatggctagctcctcactgcccttagggctctattccaagtatccctctcggtgaggttcttaaatattccaaccaacctctaacccacattcctaatctcttttcccttttctttcatccccaaagccctatcaccatttaacatattacgatcctatttatcttgattattttctattgtccatccagtggaacataaaactcaaaagggcaggtattctatcttttgttgactgttgtatgcccagcacaaagaacagtgtctggcacaggacaggtgctcaacaaatacagaatttgttaaatgaatcaataaatatcgactctccttcataagatcctttatttttaaagaagattatgctccattaattccacattttctatgaatttactctgagaactttatccattggaaattccgtaggccaataaaggacttaaagctagctttttacaaatatttgaccacaaccaatagtttaaaaaaaaaaaagtgatatggagtccaattacacaagcacatacacataaataataactacctttactacacaggctgcattctaaaattttctatttcatttttcttgtctttttcttttttttttttttttgagacggagtctagctctgtcgcccaggctggaatacagtggcgcaatctcagctcacggcaacctctgcctcccgggttcaagcaagtctcctgactcagcctccagggtagctgggattacaggcacatgccaccacacccagctaatttttgtattttttagtagagacggagtttcactgtgttggccaggctggtcttgaactcctgaccttgtgattcaccagcctcggcctcccaaagtgctgggattacaagcatgagccatggattacaagcctgagctgtgcccagcctcatttttcttaaactaaccacagacccacaaaatcagttaagcctcatcactaggtcactactagttgtttcaaaaactggtctaatgctagcaaaatgtacgcactagaaaccaaggttcataactcaccaatttctaaaaacatatcaagattcactgtatccccatgtggacccttcaaatcagcataatccaaagcataaaaattaaattgacatctaataaatgccatgcacatttgttttaattttaattaggatatcagtatctaattttggaacatatagacaatatttattcctataaatatgtgtatcaccttggaagtgaatttaaaaaggaatacaatattaagtaagcattgtcaactatatacaaactggtgtatcatgaatagtgatttacaacttaattagtagatatataatgccagaaaaaatataaggcagatatgaatacactgctctctggagtcaactaaaattggtttagtctgtctatatacaacttcaatcgcctaactccaggatgatgtcacctagcccagtgtttcctaagcattactgacatttgggactagataattctttgctgggggctgtcgagagcactgtaggatgtttagcagcatctgtgatctctacccactagaaaccagcagtagtcccccagggtggcaactaaaaatggctccaggaattaccaaatgtcctgtgggaaaactcctgcccaaatccaatcttctcaggatcacttccacatttccagtaactaccttctacataattctaaatgtattttctaacatcctctctaaagaaaatatctggccgggcacggtggctcatgcctgtaatctcagcactttgggaggccaaggcagttggatcacaaggttaggaattggagaccagcctggccaacatagtgaaaccctgtctctactaaaaatacaaaaaattagctgggcctggtggtggacacctgtaatcccagctacttgggaggctgaggcaggagaatcgcttgaatccaggaggcggaggttgcagtaagccaagaccacgtcactgcactccagcccgggtgacagtgcgagactgcatctcaaaaaaaaaaaagaaaatattctaattcacaatcattaatattctccaatatcctaaaaaatcagactataatctgacaacatggccattagatttatctgaagattaattagtttattattgttattattttttctttttcaagacggagtcttgctttgtcacccaggctgaagtgcagtggcatgatctcggctcactgcaacctctgcttcccaggttcaagttattctcctgcctcagcctcccgtgtagctgggattacaggtgcgccaccacgcccagctaatttttgtatttttagtagagacggggtttcaccatgatggccaggatggtcttcatctcctgacctcatggtctgcctgccttggcctcccaaagtgctgggattacaggcgtaagccaccatgcccggccaatctgaagattaatttttaaagcccccagaagtttatgatttactaaagttatatggagggtttgtagacagagttagcactaagatgcctaattcctgaattctggttttgtgctctttctgctaaaactgacttagtgcacacttatttctgatgatattgctgttaactgcttagtctttaagaattaaagtgtctcattggattcattttttcactctctattttgtaaacctgttcaaacctcctctacctcccagaaaatgtcaaagtaccttataagccattttaaataacttttagagcatcactcattctacctctcatgtccattcctattaatggcccccagcccaggccgcaacttctaggtttaggtccactggttacttcatttttgtacacttgtactagaccctaaattgttctgtctcttttctctgtccttcaaattatataacacaacaccacaagatggatcttaaaacacaactgtaattatatcactcttctatccctaagcgttaaatgattcctccaattctagagaatattttaggtatacataatttgtgttatgctatgggctgaactgtgttccccccacccccaaatttgtatactgaagctataacccccaatgtgatggtatatagagatggtggctttgggtaataatcaggttaagatgtattcatgaggatagggccctcatgatgtgattggcgcccttataagaggagatatcacagaccttgcttcctctttctgtcatgtgagaacacagcaagaaggctgtcatccaccagccaggaagagagccttcactaaggaaccaaatcgtccagcatcttgatcttgaacttcccagcctaaaaatgtgagaaatgaattcctgttattaataaaccatcaaacaagtaaagaagaaaaacttaaactgggttctaatgacactgctggacttcctaaccagttgctcttggttagatttttggctgttgtccatactgattaaccctccatccaaccatcaatcaaggtgaaaaagaggaatagagcaaggatcaggaacaaagctaataagttaatgaacaagttcattaagaacaagagtagcattagaccatgagagttttcttctcctctagatgtccagagacccttctctacaaatgtccaccaatggatgaatgaatgcttattttccaatttgccagaatcttgagatactggggtagggaggttagacatgcaaagatatatcagatctaacaggtttgtcctcaaaaatcaattctcacctcccatgatgggagaagccaataggagggcttcaattccaaagaaagctgagagatcagtggatgataacccaccttccagattatttctatgcattcaaacaatggcccttctactagatcattgttttttgttttttttgagatggagtcttgctctgtcacccaggctggaatgcagtggcgcaatctcggcccactgcaatctctgcctcccgggttcaagcagttttcctgcctgaggagctgggattacaggtgcgtgccaccacgcctggctaatttttgtatttttagtagagatggggtttcaccatgttggccaggctggtctcaaactcctgaccttgtgatctgcctgcgtcggcctcccaaagtgctgggattacaggcgtgagccaccgtgcccagcctctagtaaaccattgttattaccacacacgagtttttaaccacacacatactcttctgaggaaaggcttccccaaactattggtccttatgatgagatctggccatatatatttttcttctgaaccccaggattgtggggctgtcacatttcctctaacagtacaccttaggagctcccagacttgaagaaaattggctgtttcccacatttgaacattttccactttttccctcagtctacctttttgaattgatttctgactacttctagataacctttttccattaatgaatattgagtgcttattgtgtgccaggcactgctttaggcacttgagagaaatcggtaaacattaacagacagaaatgaacaacaaaaacaaactatttcaacagaaggaactaacaaacagtccagtggaggaagaaagatagtaagtataataaaaatgcaaattctctggtgaactggaagatgacgttatagaattaggaaaaaaataatagagcaggcttagaagttgaggaggtataagagaattgtaattttacgtagtgtagtcagagtaagtctcatggagaaggtaaatttggacatacacttgaaggggataaaaggtcagagaggtagcaagagtggaaatagtagtaaggatctgtaaattcttcatttttctctcagtttagtctgtggcaactgtcatgtcttttgataaggaacgaccttggtttaatagttactcccctcctagactctcaggctagattttttttttttttaattgagacggagtcttgctcttgttgcccaggctggagtgcagtggcacagtcttgtgcacagtcttggctcactgcaaactctgcctcccaggttcaattgattctcttgcctcagcctaccaagtagctgggattacaggcgcccaccaccatgcctggcgaatttttgtatttttagtagagatggagtttcaccatgttggccaggctggtctcgaacccctgacctcaggttatccacccacctcggcctcccaaaatgctgagattacaggcgtgagccactgcgcctggccttttttttttttttttttttaagatggagtctcgctgtgtcacccaggatggagtgcagtggcacaatctcaactcactgcaacttctcctgagatgcttgtgcctcagcctcctgagcagctgggactataggtgtgcgccaccatgcctggttaattttttgtatttttattagagatggggtttccccatgttgtccacactggtctcgaactcctgacctcaagtgatccacccaccttggcctccaaaagtgccgggattacaggcgtgagccactgcacctggcctctcaggctagtttcaaccctattttacactcctctaccatcctcagcttacttttgaaaaagtatttattaaaaaatatttatgaaaaagttatttttgttttatttagttgccctgggatggaatacaaatgtttgctgtagttttaaggatcctataaaactcccatttactgcaaggatctctgtttaatgggcattcaattctaagatagcaaacgtgtagagttatttgtgggggtgggggacaagtttgagaaagaagcagtggggtgaagaaagtgataggcaagggaagatggtggggataggtaccataggagtcctggtggcctaaaatctaatcacagaagttactcaagtgggactgatgcctgaaaaaaatttgtgtgtggctataacagtgagtgggatctactcttttttttttttttttgagatgggagtctcgctctgtcacccaggctggagtgcagtgccgtgatctcggctcactgcaacctccacctcctgggttcaagcaattctcctgtcttggcctcccaagtagctgggactacaggcacatgctaccacgcccatctaatttttgtatttttagtagcgacggggtttgatcatattggtcatgctgctctcaaactcctaacctcaggtgatagacccgccttaggctcccaaagtactggaattacaggcgtgaggcaccgtgcccagcctgggatctactcttaagcaacagagaaaatcagtcatttttccccttttccttcccttcctcctatgagcagaatcttggtctccatctttaaaaaaaaaaaaaaaaaaaaaaaaaggccaggcacagtggctcacacctgtaatcccagcactttgggaggccgaggtaggcagataacctgaggtcaggagttcgagaccagcctgaccaacatggtgaaactccatctctactaaaaacacaaaaatttgccgggagtggtggtgggcgcctgtaatcccagctacttggtaggctgaggcaagagaatcaattgaacccgggaggcggaggttacaaaggagatttgacagggtggcagttcaaactaaaagtggtctgatagttcagagtcaagtttcttcactaaagctgagtttttaaagggcttgaagaatgatgtaaagaggggttgtggaggaccacaaaaaaagacaactaaaaaaaggcataacaaagtcaacttattaaatgcccagcaacagggtgaagttaaggggaatggtggaataaagacctacaaatagctgctgcttcataaaagcaaagagaacactagcaaaaactacaaaaatcacgtttttcagatcctggaaattaacgaaagcttgtaaaactcaaaagattttattacaaaatggcttggcggttcctcaaaatgttaaacatagacttatgatcccacaaatctaagtatacactcaaagaaataaaggtactcaagtacatgtatacatgtttatagcaacaactcataataatcaaaaggtggaaacaacctaaatgtccatcaatggatgaatggataaacaaaccatggtatatacatacaacagaatgtttattcagccataaaagaaacgacatactgatacatgctacaacagggtaaaccctgaaaatataccatgtaaaagaagtcagtgacaaaagctcatatattgtatgatttcatttacaggaaatatcagaaatagataaatccatagatattaaacaaagatttgtggttgccagaagataggaaagggaaaatggtgagaaactgcttaatgggtaaaggggttttactttggaatgatggaaatgtatcagaactagatagaggcagcacacgtacaatattacaaatgcactaaatatcactaaactgtttattttaaaatgactgatgttatgtgactttcacctcaatgaattattttttaaaaataaagagggtatattactaccaaccacacagaaaaaaagagaattataaaggaatactatgaaaaattatctgtcaacaaattagataacctagatgaaacaaattcctagaaagacaggaactaatgaactgactcaagaacaaacagaaaatatgaatggatccaaaacaagcaatagaattagtaatcaaaaaacttccccaaataaaagcccaaaatcagatagctatgctagtaaattcttaacgtttttaaaagaattaacaccaatccttcattaactcttccaaaaattagaagaggagagaaaactttgcacatctttctatgaggctagttattactcttacaccaaaatcaaaccaagaaatcatatataaaaaaagaaaactacaggccaatatcctttttttttttttttttttttttttttttggagacggggtctcgctctgtcgcccaggctggagtgcagtggcgtgatctcggctcactacaagctccgcctcccaggttcaggccattctcctgcctcagcctcccgagtagctgggactacaggagcccgccatcacgcccagctaatttttttgtattttttagtggagacggggtttcactgttttagccaggatggtctcaatctcctgacctcgtgatctgctcgccttggcctcccaaagtgctgggattacaggcgtgagccactgtgcccagccaatatcccttacagaggcaaaaatcctcaacaaaatgttagcaaacaaaatctaacaacatatataacgattacataccatgaccaagtgggatttatttaaaaaatacaaggatggttcattctatgaaaatcaaccaacaataattttatttttattatttttaattttaattttttttttgagtcggaatttcattcttgttgcccaggctggagtgaaatggcacgatcttggctgaccacaacctccgcctcccgggttcaagcaattctcctgcctctgcctcccaagtaggtgggattacaggcatgcgtcaccacgcccagctaatttgtttgtatttttagtagagacatggtttctccatgctggtcaggctggtctcgaactcccgacctcaggtgatccgcctgccttggcctcccaaagtgctgggattacaggcgtgagccaccatgcccagcctataccattttaataaaggacaaaaactacacctgcctgcagaaaaaacacttgacaaaagctaacatccttttatgatttgaaacaacaaaacgattaggaatagaaggaaactttctccaccagacaaaggcatctgtatgagactcacagctattatagtatcatacttaatggtgacactgaaagtacccctgcccctaagatcaggaacaagacagatatccactttaaccacttcaactcaacaccgtactagaggttctatagccaaggtaattaggcaagaaaaggaagcaaaaagcattcagattggaaagcaagaagtaaaaccataatggagatgacaaatacaaataactcaattttttaaaaggccaaagaacttgaatagacatttctccaaagatgatacacaaaagaccaagtaaatatattcagtgtcattaatcataaaagcaatgcacattaaaaccaccttgagataccacctcacacctagtaggatgactactattaaaaaacaaacattgttggaaagaaattagaatcctcatgcacagtcactggattgtaaaatggtataactactatggaaaacagtacagaaatgcctcataaaattaaaaacagaactactatatgttctagcaatcttacttctgggtatatatctaaaataattgaaagcagggtctcgaagagatactggcacacccatgttcacagaaggactattaaaatagccaaggggtagaagcaacccaaatgtctacccaaaaatgaataaacaaaatattatatatatatatgcacacacacacaatagaatattattcaacctcaaaaaggaagaaaatctgtcacatgctacatgtttgaaccttgaggatattatgccaaataaaataaaccagtcacaaaaagacaaatacttttgtatttgtataattccacctatatgaggtaactaaaatagtcaaattcatagaaacagaaagtagaggccggaagcagtggctcacacctgtaatcccaggactttgggaggctgaggtgggcagatcatctgaggtcaggagttcgagatcagcttggccaacatggcaaaaccctgtctctactaaaaaaaatacaaaaattagccagatgtggtggcaggcacctataaacccagctacttgggaggctgaggcaggagaattgcttgaacccaggaggcggaggttgcagtgagctaagatcacgccactgcactccagcctaggcgacaagagagaaactctgtttcaaaaaaaattagctgggcgtagtggtggcacacacctgtagtcccagctactcgggaagctgaggcagaagaatcccctgaatctgggaggcagaagttgcagtgagtggagatcgcaccactgcactccagcctgggcaacacaccaagactccgtctcaaaaaaaaaaaaaacaaaaaacaaaaaacaaaaaaccaaaaaaacaaaaaacagaaggtagagtaatggttaccaagggctaggggcagaggaaaagggtgagtctgttgtttaatgggcattgtttcagttctgcaagatgaaaaagttctagagatctgtttcacatcaatgcttgaaactactgaactattaatttagaaatggttaaggtggtaaattatatgcgtttttaccacaataaaacaattcattttaaaaacaggccccaatcggcatggtggctcacgtctataatcccagcactctgggaggccaaggtgggagaatcacttacagtcaggagtttgagaccagcctggccaacatagcaaaaccctgtctctactaaaaatacaaaaattagccggcatggtggcacgcgcctgtaatcgcagctactcgagaggctgaggcaggaagaatcacttgaatccaggaggcagaggttacagtgagccgagatcatgccaccacactccagcctgggcgacagagtgagactctgttaaaaaaataaaataaaataaaaaataaaaaataagctagacacagtggctcacgcctgtaatcccaacactttggaaggctgagatgggaggatcgcttgagcccaagagttgaagatcagtccaagcaatgtagtgagaccccttctctacaaaaaatttaaaaacacaggcacagtggctcatacctgtaatcccagtattttgggaggctgaggcaggaggacttagtcagctcaggaattccagaccagcttgtacaacatagtgagaccctacctctacaaaaaattaaaaaattaaccgggcgtggtagagtgtgcccgtgatcacatcactgcactacaaccttggtgccagagcaagactgtctcaagaaaaaaaaaaaatttaaatttagctgggcatcatggcacacgcctgtagtcccagctactcaggggtggaatgaggcagggtggcagctgagatgggaggatcactggagcctgggaggtcgatgttgcagtgggccataattgtgtcactgtactgcagcctgggcaacagagcgagaccctgtctcaaaaacaaacaataaaaaatgggcgaaggatttgaacacttctccaaagatacacaaatggccaagcagcacatgaaatgctgctcaatatagtcattaaggaaatgcaaatcaaaatcacaatgagctattacttcacatccactaggttagttataagcaaaaacaatctcaagcgttgcagaggatgtgcagctatctgaaccctcaaatactgctggtgataatataaacttgtactttggaaaagtttggcaattgctcaaaatttaaatatggcgttaccatatgacccaacaatatcactcctaggtatatacccaagagaattgaaaatataacacatatataagctagctggaatatagccataatgctgctacaaagtgcaaacaaccgaatgtaaattaattgataaatgaataaacgaactgtggtatatccgtacaatgaaatactattcagccataaaaaaactaagtacaaacaagcatacaatacggtgtaccttgaaaatacactaagtgaataacaccagacacaaaaggccgcatattttattattttacttatacaaaatgtccagaataaggcaaattcatacagacagaaataaagtagcagctgccatgggctcgatgaagaagaatgaaaggaatatagcaggtttgaaaaatggcccccaaaatatcaggtcctaatcccttaagcctgtaaatgataccttatttggaaaaaggatctttgcagatgggaaaattatcctggactatacaggtgggccctaaatgccaccacaaatgtccttgtaagagaagcagagggagatttcacacatactctaggaaaaggtgatgtgaagacagaagcaaagattagagtgacatggtcacaagccaaagaacgtcacatccacaaactagaagatgcaaagaatggattctccgctagagtttcccaggggaggacagccctgccaacatcttgatttaggtcttgtgaaacttattttagacttctgacctcccgaactaagggagaataaatttttgttgttttatgccaccaagtttgtgataatttgttatagcagctatggaaaagtaatatagggagtgactgctaatggatacaaggtttctttagagttgatgaaatgtcttggaattagatattgctgatggttgtacaattttgtaagtatataatactaaaaaccattcaatttcacaccgcaaagggtgaattttatggcatatgaactatatttcaaagaaaaacaaatgcctagtaacaggctggtataacccgccatctcccaacaactgctgctaaattttcaaagcaccattaagcagactcaattcgtagcaaggataatggaacaatgcaagctcatctagcgaacaaaaagaattaagctagtatcaggtggtcaatttacaaactgtagtgggagtcatacattcccaaggatggaacagttatatctccttgcagagtgaactcttctccgataccaaggacttggaagaccaaataaattatacgtaggattaccaaatatgctggtatgaccaagacagttatagtttaaacttctatctctgtggaattatggatagtgccactcttcaatctttaataagtccttcagtttagatgataaattacatagtcaacctagttataaggaatctagaggttgtgaaaagctgtgagagcatattctatgcagaccacataggtcctatcatgactccctatgtaacttgggtctctgcgactgggaagctcccagggaaaaaaccccagttaagacttctgcagagcattcacattttgtttcaaacttatacaacactaatgctaaagctcaactctcagaattgtattattcagtattatccaaataactgattaatttacacactgaagggaaagaacaaggaatggacctatacacacttgtagtttacaagtataagaagctaacaaagaataagattaaaataacttgtgccaggccgggcatggtggctcacgcctgtaatcccagcactttgggaggctgaggcaggtggctcacgaggccaggagtttcagaccagcctgaacaacatggtgaaaccccatctctactaaaaatacaaaaacttagctgagcgtggtggcacacgcctgtaatcccagctactcaggaggcaggagaattgcttgaacccgggaggcagaggttgcagtgagctgagattgtgccactgcactccggcctggacaacacagcaagactccgtctgaaaaaaaaaaaaaaaaaaaaacaaacaacttgtgcccacattaactaggtgttaaaagccaaaaggtgaaagtcactattctcttttcacatatcaaattgaccctaaggtaatattgctgcattagaactgagctggtgggagggatgttaagaaattagggagaaattgttaatctacagaaagaccatcatataaggttctgtgtgtagccaaacatacacatttgatgttctgatgtttgctattttagtggaactatagctataaaatgtattcaatcagtagaattaaaacatatcccagtccacaaaaaactaagagagaaattatacaggaatgatcaagaatctgcacagttctcataatctcattactagagagaaaaggagaaagggaagcatcaaggtagtatttgagacgaatttaagaagaccactcattcaataaaagtttggtgggccaacaaggtgccatgtattggtctggtgatatagcagtgatccaaagtctttcacttcagggagctgacattccagaaggagtagtcagaaaataatttttttaacaaaagtaacatggttatataaacactagggagaaaaataaagtaggaaatggaggcaggttgatactcacataacatgaatatggctgtctggggaagaatactccaacaaagggaacagcaaacacaaagcctctgagactggagcacttaacacatgcaaggactgatcaataggctaacacaggtggaccaatgaaaagagtgacaagttagaaatgagataaaaaatgagctgtttgtggcaaaggaaagccaagatcatgtaggccattctaaattcttcagctttggccaggtgtggtggctcacatctgtaatcccaacactttgggaggccgaggcgggtggatcacctgaggtcagaagttcgagaccggcctggccaacatggtgaaaccccatctctactaaaaatacaaaacgtagccaagtgtgctggcatgtgcctgtagtcccagctactcgggaggctgaggcaggagaattgcttgaacccagaagacagaggctgcggtgtgctgagatcatgccactgcactccagcctgggtggcagagcaagactccatctcaaaaaaataaataaaaataaaaataaaaataaaataataataatacaaaaattagctgggtgtggtggcgggcacctgtaatcccagctacttgggaggctgaggaggagaatcacttgaacccaggaagcagaggttgcagtgagccgagactgcgccattgcactccagcctgggtgacagagcgaaactccatctcaaaaaataagtacataaatagacaaaaaataaaaacaaattcttcagcttttaccctgagtgtgatgagagattactggaaggctctgagtgagaagtaatatgatctcactcatttcattaggattgctgtggttactgtgtggagaatagactttagagagtaatagtggaagcagaagacaagaagctactgaaatattataaacaaaagatgatggtagtatcagacaggatggagaaatagagatactaagaagtcggactctagataaaaatctagaaggcccaattcattgatggattgggtttgggatgtgaaggagaggaggaggacacacaagaggtaatgctgagcaggtaaatctatgagatcagagcccaaggaaagttccgaggtaggtacttaaattttgaagtcttcagtatgtagcattatttaaaacacaagactggatgagatcactcagggaaaagaggtctgagatctaagctctggggcattccattgattagaggtcatggagatgagaaggagctggtaaaggaaattaaaaaaaaaacaattattcacagccattcaggtgggaggagaattgagaaagagaagcatcccagaatccaatggggaggagaaaaggaactgtaatatatgctgccaatagatcaaataaaatcacgaaaatcaactaaaactgaccaatggattaagcaaagtggaattcattggtgaccttgacagcagtgggtttaaggaagaacgagaacaggagatagcaaatacggacaactctggagaaattttcctgtaaggacaagcaaatacaaattaaaacaagcagatgggagatgtggcatcaaaaacgagatctttaaggtgaggtgatggtacaatcagtatgtttgctatattaatgatctggagagatagaaaacttaaccctagacaaagagaagtcttgctagaataatatccttaaataaacaagtgcacatgtagaggttctggccttagcaagaagtcaaattattcacccagagtaacaggacaatgctttgagatcctatggaaaagggttaaatggtggataaatggttgcggtggccatcctccaagatggccctaaatgaatcccacttcctggaattcacatagttgtagccctctcccactaacagggttggcctgtgggatcaagcacatacagcaggaagtgatggtatgccacttcagaaattaggtcataaagactctgcccttcatcttgggtacaaggtctcttgaatcatttgctctgaagtaagccagctgctgtgacatgaacagccccatggagaggcccacagagcaaggaactgaggcctcttgccaacagcccagtgagtgagcttagaggcagatgatccaaaccaagtcaattccgcagagactgacaatccagccaaaggtttcactgaaacctcatgagtgaccttgagccagaaacagccagctaagccactcttggattccagaccttcaaaaactatgaggtaataaatttttttttaaactactaagttttgagacaatttgttacacggcaatagataactaatacaatgggtctcactgagctgtaatcacaaattgctgggcacacaattcactataatctcacctactggcatgcaatgacttcagatgacctcccctgtcctgctgcatgcagttacctcatgaaatacagtcgctgagaaagagggtaggataaaaggagtcagctttatataacttaacatccctgatgctcttttttttttttcaagagatgtggtaaaagaatgccactaccaccctctcctttctcaacaaagcaatttagagggttcccgaatgacctacatcaacaattggcctgaactaatcaaacgcatcattcagattccctcagtaaaatattgaataccaaacagctatgcttcagcaaaggaaagggcaagggagcgaaactgaaggacgaaaatacaactttggtcctcatcagggagacttctcttttcttacctcaggtttattacaacgcaacttttaagaacttgagctattccaggcagaaggtcacatccttgaggtaaccagagagaagcattagttacttacatgtcacaagaatattttcgatcccactgcctgacattgccatttaggtgtttatcaatcatctcacacttaaccagataagtgaactgaactcctttcccccagatctgttcctccaatctaccctaccttagcaaaggaaaacgtcccacccgccaactgcccaaatcaaaagcctgcaaatcacccgaggtcctggctctcacgggagggactccattagggtcccaggggctgcattaagagtcccgacagcgacgcagtaaatgagacaagacgctgcggtaggggagagagacccatacattcaaatgccttaaggggtctgggcctacaggtctccagaactggggagggcctggggttacaaagcagttttcagatttttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtcagggttccagagctgagggggtatccaagcagtcagggttccagagctgaggagcatccaggcagtcagggttccagagctgaggggcacccaggcagtcagggttccagagctgtcgcagccagggcttggggtggggggtaggcttccagtccatcaggggatggtttgcccaccagaaggccagctgttataatt

SEQ ID NO: 876 - DNA, 11429 bp, Homo sapiens
gtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacatt

SEQ ID NO: 877 - DNA, 11429 bp, Homo sapiens; identical to SEQ ID NO: 876

SEQ ID NO: 878 - DNA, 11575 bp, Homo sapiens; identical to SEQ ID NO: 873

SEQ ID NO: 879 - DNA, 11575 bp, Homo sapiens; identical to SEQ ID NO: 873

SEQ ID NO: 880 - DNA, 1588 bp, Homo sapiens
ggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcaggtgctgtctgacctggctgggcggtagctttggctccaaggtccgctccccggtcagcgagatcctgttcaatgatgaaatggatgacttcagctctcccaacatcaccaacgagtttggggtgcccccctcacctgccaatttcatccagccaggtatggggtggaggtctggggatgggggactggggtggagaggggcgggtgtcctgggcaggcagctgacgggcatccctgtcttctcccatcggccacagggaagcagccgctctcgtcaatgtgcccgacgatcatggtgggccaggacggccaggtccggatggtggtgggagctgctgggggcacacagatcaccacagccactgcactgatatgtgtcaccccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggtgggccgggggttggagaaactgagtcacggtgtggggccccagggcatcctgggctggaggcctggatcatcacagagtggacaattgttggtgtcctctctctagtgcctgggccatctggagcccctgtgccatgagggccaagccccctgctccagtgagacccagcaggccccaacctgctcttcctgatgacctggcccgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtc

SEQ ID NO: 881 - DNA, 12986 bp, Homo sapiens
tgtgtctaaacaccacgccccacccccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagacgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcacatagggagcaggtctcctgtgttatggcccaagcagggctgttaggacactgagaacattccctcctcccgcaggagagagaggtccaaggtgccctacatcgtgcgccagtgtgtggaggagatcgagcgccgaggcatggaggaggtgggcatctaccgcatgtctggggtggccacggacatccaggcactgaaggcaggcttcaacgtcagtgagtgtcggcctgcgcaggacgggatggaggtgtgggcagtggtgtccgcgatgagatctcagagtgctccatggcccaggcatgtcacatccttctctgtgtcttttcttcatttactgttttattattttaaaaaaagagaaaacaagagttgtacaaacagcttctatagaagccagtttttacaccatcgtacccactcatgccacttggtggagtggaccaggggcttctgtggggacttggccttcctgccttgggggtggacaggaggtggaagcccaggactcagtgcggtctgtccactgccctgtatgaggatgtggtgggcagagggcactgatgaaattcagcgcaggccggggctgcagcatctccgcctccatctcaccaaccctcacaggctttgaaggacccagactggcctcaaatgccaggggagggcactgagaccccagagggtccctcccagcatcttcaaagcaacaggattttgtgcctgcaggcccttctttgcagcacacaccacccaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagtgtggcagggacggtgctttagccaaggcagggatggcgggtgactcactcaggatcttcaaggaggccgctgcatttccatgctctttccagataacaaggacgtgtcggtgatgatgagcgagatggacgtgaacgccatcgcaggcatgctgaagctgtacttccgtgagctgcccgagccccttttcactgacgagttctaccccaacttcacagagggcatcggtgagcactggaggccttggcctcgtgggagatgtctcccccatgtgcactgctgccctcggaggctgtgaaaagcgaggtgtgggaacctgagttgtaacccctctgccatggtcggcattttaacccaacctcaaaaagcaggggaccagaaccgagcctgtcctggaaggccttgcccatccccagagggctccccatccctattcctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgtccctcactccgctgtttcattccatgctgagcctcccctgccttgggctccctggggagggggtggtggcaggagttgcccaagggctgctctgcccatgagcagctgctctagcggctcctcctgctgctgttcgccaggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtcccgggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgttggggtgcccctctgctcccaccagacccccagcaccaaggaccttttcccccgacccctgtctgcagtaactcactgcttctaaggactagcaccactgccacccctgcccctgcctctcctctttgccacccgcctccctctgcactgtggccttaacaaagagctcagagctttggccgtggccagcagtgcatttggaccgcccccacttccctcccaagcacatcatgaagacctccccatcagcccagagctggccccttgtcccgggccactgagacccagaagtaccaaggctggagtcagcttgcagcacagccagggtcgaggtcactccctccctgaggactctagcatggcacagcccctctgcctctctcctggtggtggcgttgaaacagcaccctctgcttcggtcctctacagggtggcagagaaggaggcagtcaataagatgtccctgcacaaccttggcacggtgtttggccccacgctgctctggccctccgagaaggagagcaagctccctgccaaccccagccagcccatcaccatgactgacagcaggtccttggaggtcatgtcccaggtatgggaagacagcctccagcccatgcaaccccagcctgacagaggtggcctctgcctgccccacccccagtcctgcccatcttcccacttgcattgtatgtggtggtggctgagattcagagagagggacttgcctaggtttgcatggatgggagtgatagggggtgcccaggccacctcctggtcctgctggtgcatcttgctgggggcttaaaaccaccccaagtgttcgggtgtggtggctcatgcctgtaatcccagcactttgggaggccaaggcaggacaaccgaacccaggtgtttgagatcagtctgggcaatgcagcaaaccccatctccagaaaaaatagaaagaaaaattagtcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggggcttgggccccaaagacctccccaccagcagctgtgagcccccctctgagccactctcctcttccccactctgcgagggcaggtcgaggtgctgctgtacttcttgcggctggaggccatccctgccctggacagcaagagacagagcatcctgttctccaccgatgtctaaaggtcccagtccatctcctggaggcggacagatggcctggaaacctctggctaatcgggccatctgtagagtgggaatcaagattttctgaggcatccttgggccacccccaggtgtcaggccatctgccaagagacagtggcccaaagcagaaggacaggtggcctgggcagatcccgcccaggtctgaaagccccaggctggcctcagactgtgggttttttatgtggccacccgagggcgccccaagccagttcatcttggagtccaggcctggccctgggagacagggtgaaagcagtggtttttatgaacttaacttatagagtctaaaagatttctactgaatcacttgtcaagaagcgccctctctggggagaagggaacgtgaccggattccctcactgttgtatcttgaataaatgctgctgcttcatcctgtgggggccgtggccctgtccctgtgtgggtggggcctcttccatttccctgacttagaaaccacactccacttagaacagggtttgagaggcttagtcagcactgggtagcgttttgactccattcttggcttgcttctttttctttccagaaggatttttgtgcagaaatgggtcttttgttgccgtgttagtcctccttggaaagcagctcagaaggcccgtgaaatgtcgggggacaggacccccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatgcttgaatatttttaagttttatacatagtttctaatttttttcccagcagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacagctgcgggggagcccaggcattctttgtaagccctcctgactacctgactcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctccccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgcttgtggacctggcaaggcagggagcagaaaacagagccccttgaaggcttcctgtctgcgtctgtgtgcagtgtggatttagttgtgctttttacttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcaaaggcctagatgccagtgtgacctcccacaaggcgtggcttccagactccccggccggaagtgatccttttttgccgcgggccctgagtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacgtggaggattcctgccacacagcctgggcccggtttcttacctgtggccaccgctctggcacgagcccctcagtcttgggtggtttctgcctggtccgggatttggtgttcctgctgagtccagcctttctgccacctccgcatgggccgtgggtggtgttgtcagctgcctcccaccttggcttcagtagctcacccagctcacaggggagctgccctgggctggagatgggcatgcaccctgggtcctacttgaatgaatgcagcttgaggagagccggccatatacactgggccacaggttaccctcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcggagtgtcaccgccaccatgatcatttccctgacactgcgagggtgtggggacgtcctgggtagagacagggcccgtggcagcagcaggctcaggggcgccctacactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgaggaaagggctgccgctggcccgtttctgagtgttcagcacctaaggatgacagcactgtctgtccctaccctccgggtcctgtttgaaaatcaaacccatgctcacaggccaatttttttttcttttagagacagggtctcactttgtcacccaagctggagtgcagtggtgcgattatagctcaatgcagcctccaattcccggactcaagggaccttcctgcctcagcctgccaagtagcttggactatagctgtgtgttttcttattattttgtagacatggggtctggctatgttgtccaggctattctcaaaattcccggcctcaagcaatcctcccgcctcggcctctcaaaggttgggattacaggtgtgaggcaaggcacccagctcagccacagagccctattgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccaatgcgcacagagcacccccagctcactcggggtctcagagctgatccatgagcggaggctgagatcctgggatcttgtcccccagcctccctgcaaccttaatcccgttctgctgaaagagatggggccggacctcgaccagcagccctggcctggacatgactgtgctcatgcaggtattgaggccgagatgccccggcatcatatgtttttctattttcttttttttttttttgagacggtgtctcactctgtcacccaagctggagtgcagtggcatgatattggctcactgcaacctctgcctcccggttaaagtgattctcctgcctcagccttccaagtagctgggcctacaggcttgtaccaccacacctgactaatttgtgcatttttactagagacggggtttccccatgttggccaggctcgtgtcgaactcctgacctcaagtgatccacctgccttggcctcccaaagtgccaggattacaggcatgagccatggcgtcacttaaatgtagtgagaggccgggcacagtggctcatgcctgtaatcccagtactttgagaggacgaggctgtcagatcacctaaggtcaggagttcgagaccagcctggccaacatggtgaaaccgtgtctctaaaaaaaaatagaaaaaaatagccctgcatggtggtgagtacctgtagtcccagttactcaggaggctgaggcatgagaatcgcttaaacctcggaggcggaggctgcagtgagctgagatggcgccactgcactccagcctgggtgacagagcaagactttgtctctaaataattaaataaataaatatggctgagcatggtgccttaggcctgtaatcccaacactttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcacttgaaactggaagtcagaggttgcagggagccgagattgcaccactgcactctagcctgggcgatggagaaagactccatctcaaataaataaattaataaatacagagcaagattccatcttaaataaataaataaataaacatacacctgtaatcctagcagttcgggaggctaagacaggtcgatcacctgaggtcaggagttcgagaccagcctgaccaatatggcaaaactccatctctactaaaaatacaaaaattagccaggcgttttgatgtgtgcctgtagtcccagctacttgggaggctgagacaggagaattgcttgaacccaagaggtggaggttgcagtgagccgagatctcggctgcacttcagcctgggtgacagagtgagactgtctcaaaaggaataaaaaaaatacaaaataaaaaaaatgtagtaagatggcagagtcgtgccgcggaagcgtgctggtcctatccatgtagtgaaggctgatttcatacagaaatgtcacaagaactttttttctttttctttttttttgagacggagtctcgctctgtcacccaggctggagtgcagtggcgcgatctcagctcactgcaagctctgcctcccgggtttatgccgttctcctgcctcagcctcccaagtagctgggactacaggcctgtgcagcagatgcaggggggccactaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggcctggtcctcaacctgcagtgcactgttgatgcactggaatgccgcctccttctcccagtccaggtcttcagcagtgacccggtaccccagctctaagggaggtggcagcatcaaaggctcccctcgcctgcgtggcagcaggggaaacttgcatctacggggcctagaggcctgggatatgggggagccacccctgggagcgagtgtctgccctggtgctgtatctgccgtcttttcacactgggtgtgacccgaagagacagcctgaggtccgtcctcactcactgtgtttgaggaactgagggtcagctggcagtgggatgaggctggcccctcttccactttcgttccgggaggcctcccgtagagctgtaggggctcgagatggcatttcatttggggcacgagctggtccgggaggtctgcgatctctggttctgacctctgggcacctgctgcagctgtggctgaggcccagaaatgtgaagggcctccatccactccagtagtgaccccaacgtggggttcaatgcggaggggggaggggctgctgcggcagctgcaggagcagaagtgccacgccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacctctgcagcagatgctaagggggccagtaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggccttgtcctcaacttgcagtgcactgttgatgcgctggaatgccgcctccttctcccggtcaaggtcttcaacagtgacccggtaccccagctctaagggaggtggcagcatcaaaggctcccctcgcctgcatggcagcaggggaaacttgtgtgtactgggcctagaggcctcggatgtggaggagtcattcctgagggtgagtgtctgccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctccattgtcccgcaggggccgaaatgcagacggtgcatccccggtgacctccgggacccttctctgatcaccaggattctcttggactctagggtccttgtcctgctcaggcatccctgccccgctctccttgagggccctcaacactatcttccctggacacaagtctggggacagccgggtgttgtggaccccaaaggggtgactcccggctcctgggccccacagagagtccatgttctcagtgcagtggctgagctggaggacgccctggaactcggagcacacagcactggcttgctgtggtacctgtgcaatcaaattgaaggcaggatcccaggaaggaacgcagcgcttgcaggatcaccgaaaaccttcttagagttgtcttgacaccactgatgtcaagtgtctgggtacttgtaggatggcctgccactcagtgcacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagttt

SEQ ID NO: 882 - DNA, 97 bp, Homo sapiens
ccagtgctggggtctcaggaggcagcgctctcaggacgtcaccaccatggcctgggctctgctcctcctcaccctcctcactcagggcacaggtgat

SEQ ID NO: 883 - DNA, 8055 bp, Homo sapiens
cagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaa

SEQ ID NO: 884 - DNA, 8055 bp, Homo sapiens; identical to SEQ ID NO: 883

SEQ ID NO: 885 - DNA, 103071 bp, Homo sapiens
attgctagtcacaaagcccaactttttattgaagtataacatacacacagaaaagtgcccagatcaaaagtgtacagctccaagaatgttcacaaacggaaagcacccaggtaaccggcaaccagatcaagaaacagaacaccccagaagcaccacctcatgcccgcttctggttactgtcttcttaggactgatctctacttgcaaccgcatggatgaattttgctgggttttaaactttatataaatggaatcctatggtgcatttttgccttatctcgttcaacactagggttggtgaatacactccaagttgggggtggagttgcagctcattcccattgcagtctgggattccatcgtgtgaatataccctaatgtgcttatccagccaacatgggcattggggtgctttcctgttcggggttattatggagagtgtttttgtgaagatttagagcatgtctctggatgaacacatgtacacatttctgtagggtatacacctaggggtggaattgttaggtcatatatatttacatccaactcaagctctttcatgaaagaagaaagaatgtactggatggagtttgctggctcaaagaattgacagaaaactagaagggaggtctgtaggaagataggtggaggcggagacagctcagcgagtccaaggagtggagcagaaatgacattcccaggacgctgccatccctggacattgctaccagtggacacaccatccctgcagcctgccagccctacccacctgccttgctgtatgactaccaaccccggaccacggtggcttccttgaaatgagtctcagcatcccttcatttgtgtcacattctccaggctcatagccccaagcaagggtccaggtagtccaccccaggtcaatgaccacttcccgactggtatggggctggaagcggggtgtgcctgagagacaggaaatacttcccttcttcagcttccacggtgggtactgcacaccactaagtttatatctaaggcatgatgtccctgctgtaggaagggaggggagatgctggacagttaagctgaaaacacaaaaatgacaactgtccccacagctgcactccacaatgcaagcaggctttattccattcatcttccactgacagagtgggggagctcagtgacatgtctgtggatctcacagctcatgtgcagaaatctccatctaagaagagggaactaggccaggcgcggtggctcatgcctgtaatcccagcactttgggaggccaaggcgggcggatcacttgaggtctgggcttcaagaccagcgtggccaacatggtgaaactccgtctctactaaaaatacaaaaattagccgggtgtggtggcgggcgcctgcaatcccagctcctcgtgaggttgaggcacaagaatcgcttgaacccaggaggcagaggttgcagtgagccaagattgcgctactgcactccagcctggacgacagaaagagactctgtctcaaaaacaaaaacaaaaacaaaaaaagaagaggcagctggattcaggatcactctaggaagggtgacccgtccccaaatgccataggtctggaagaggtgcagtaaaaggacagaaaagcatctcacaggggaaggtaaggaagagaggaggaaaaggaaaaggagagagaacaaaacggaggctgaatctggagggacggggcatgtaaaaacaacagggagaaggtttggtggaagaggaaagcagcatttttctgacctgattttgatgctctctgtacggccccgctttctcggcttctctgatgtgcctttatgacttgtgcttcgcttcatcgggttaatgatgttgacgtgaagcacagaataaagagatcctggtcataactgcactatcaaaggatctgaggtcctagcgtcacatccagcatacaattctgctctagtttgagcatcttaacaacactggtattattagtgagctgataatgaaactaagaatgagttttaacaaaagaagcaaggaacaaagatgtcctaaatccatttacgagggcagcaagtcattaattggtctggaaattacatttgcctctttgcaggcaattttatgcctccaacggaaccatggtctctttgaagtcatccattcttccctatattataccacggcatttagtacatttatttgttttaaatgataatcagagctttcatctatgtagcatctctgtttcctcccagacagaaaggcaggataattaccattaaacccaatttgcaggttagaacatttcaggcacaaatggcctgttctctatcacacagcaagtctctttcagaactagggagagaggcagtttccaaataaacagaatagaacaaacttacacaaagagctctgctcccactgtgtattctcctctttcatcgggatcatatgagtttggtttaggtaggaccttcaggttgatcttagacaatccaagagctaattcatcgatgtctagcctttccttggggcatccatgaatcaccttccttaaactaccagaatacggcttcctcctggagaatgtgggaagtgaagtgtgccacgggttactgcaacaaaggtgtttgcttcacggtgtgcagttatgatagtttgtgggtctccctacctgcaaacaggtagacctggaaggtagcacagttcagggggctaagggaactctggggccgggctgcctgccctcaaatcccagtttttctgcttaccatgtgtaaccttgggcaaactacataaacgctttgtgcctcagtttcccctcactctaagacatacggccgggtgcactggctcacacctgcaatcccagcactttgggaggccaaggtgggcagatcactcgaggccagtagttggagaccagcctggccgacatggtgaaaccccgtctctactaaaaatacaaaaatgagccaggcatgttggcgtgtgcttgtcatcccagctactagggaggctgagacatgaggatcacttgaacctgcgagtggaggttgcggtgagctgagattgtgccattgcattccagcccgggcgacagagcaagactctgtctcaaaaagataaataaataaaataaaacagacatgcacttatggtatttattgttggaagattgagtaccttaatgcacaccaatgctcagatgacttgggggcacataggggactgctgtcaccatgcctcactcctgcagggaaggggctgccctactaaaaccccagcgggcccagtgctgtgtccagaacaggtccttatattactgcagcccacaatggaactactgagtaggagccaaaagaggagggagcaggaagaggtggcatttggagaggggagaccgcacccacaggtctgccacagcgcgtcaacggtatggggtacttttacagtcaagttgacttcggtgtccgcccaccatctacctttgtaggaccactgaaacaagggacatccaccacggcccacagccggggcgccacggccccaggaggatatgctaagaaaaccattccacggccgggtgtggtggctcacgcctgtaatcccagcgctttgggaggccgaggcgggtggatcacgaggtcaggagtttgagaccagcctgaccaacatggtgaaaccccgtctttactaaaaatacaaaaaattagctgggtgtggtggcgcgtgcctatgatcccagctactcaggaggctgaggcaggagaatcgcttgaacccaggaggtggaggtcgcagtgagctgaggtcacgccattgcactccagcctgggtgacagagcgagactccatctcaaaacaacaacaacaacaaaaaaaaaacaaaagaaaaccattccaatcctgtgggttgttgtctttttactaggatgatggaaatgcaggaaatacagaacctctgcagctgctttctccaggaaaggagatgaaaacgttatatgtttcagttggtcaaaatgctctaatttgatactgaatattgcaaataagggatatttaggcatagttttttttttaaaataaattatccactgaaatgtattaatatgatataaacttggaaactgatgtttaaaaattttaaactcttaagtccagacttacttttacatggcacatttgttatttggctataaacattttgattttctttgccaataatgaaaataacatgaaaatgaaaaggaaaaaaatgaaattgaatgccacgaagaaaacagatggaaacataagacaagccccggccactgttggctgggcagggatgggtgttggtctcactccctaaggcttagagcatgcatggtctctacaggggactttgaaggtcagaaaaggaggcgttttcatcacacacggagttagagaatggtacaaaagaacttcttctcgcgaaaggggttttctgatgcaggcactggaatgatgagaggatcttcccgcacgtgagcttcacagtaggccaggaggtccgcagctgcctgggagacctgtgagggcacagagcacaggtgctcagttaaaggcccctttgcagagtgagtccagggaagaggtgtccacgtacagaggggacaagccctagggtaggctgtattgtgtgcacggcctacaacatggtcatgcccaggctggagggagggtttgtgcagatctaggagactggttcgaagcgggcctccaagaaggggaggctgccctcgcatggcaggccagcatggagacaggactgagggctggcaggaggcccagacagccttgatatattctcgagtaggtgaggagtggaggttccaggacagtagtctcacaatgactttgctaaaccgtttctggaagactaaagcagaaggcagcccctggccaagccagtgtgatcatatttattatcattattagttgttttattgcaatccactcttgtgaccaacacagagagacacttcatcctcctcaacagaacttgtatttagctatattttataagcacacgttttatttttattcatttttcatttttatttctttttttgaggcagagtctcgctctgttgcccaggctagagtgtggtggcgtgatctccgctcactgcaacctccatctcctgggttcaagtgatgctcctgcctcagtctcccaagtagctgagattacaggcactcaccatgcccagctaatttttgtatttttagtagagatggggtttcactatgttggccaggctggtctcaaactcctgacctcaggtgatctgcccacctcggcttcccaaagtgctgggattacaggcatgagccaccgtgcccagccagcacacatgttttaacttggagtggccacttccctgcggagagaggtgctcctgaccagaaagttctttccattccatttctttccaggcttatctgaagcctgctggcgcatggcagttgtgcatcaaactgtccccaagctcaaggccagaggaagagcaggttgggagagggcggggtgcggacaagcatttgctaagagggagaggcagttaccagcttattttgttcatggtctgtgtcatgtgcttggcagataaatggcctgtgcattaactcatcctgccaattaggctgttctgcctgcgagtatttattagcggattacaggcaggggtaaatacatagcagtcaaatgaaatccttttagtacattcaatgtctaaatcttccccagaatgataaaaatgttccacagatgaagaaaaaaaatgtttagaagcctccagctacacaggccatacacattcccttctgggttttaaaaattggctcatctttcagcattttacagagattcttctgattttcagacctaaccgctttagcaatggctagaaataattccagcagagatatacaatgaatcaactaaacacatcactcaaataaatcaacttgaagtttagcagatgagttagtctaaatcctgacaaaacctacatttgttaagaatgtggcatggagaaatgagttccggtgaacatcaggcttctagatctacccccgcccgtaagctagctgtgtgaccttgggtaagcagctcaacctttctgagcttcacttccctcatttgtaaaattcaggagcgttggagagctctaaggtcccaatttactctaagacgtctatgattctacctttaatagcatggtcagtatttaagatcctaaaaacgtgtatgttgagttgaataggagtgtttgaagtttgcagtgggttacaggacgcccatataggaatttcccagatgggtgaggctcaggggaaaactgagcctgtggggggcctgtgaagccatcacaaggagcaggagcacaggcttaaggaaatggactctgaggcccacagggctgcgatggacacacaagagaatggaatcacatggtgagtgctgcaactcaaagccggtggacttgggagattgagccctcccttgctgccaccttctaaggaaagccaagtgccctccccaactgctggagtgatgacctccttagtttccactcctggcttctcaccatgcccagagatgcagaagctgctgaggtctggggtctccctcatggccaccatgttaggacagccactaaattcatccattgacccctctggcaacccctgggcagtggtcttcactgctgcctgggcagcacacacaagggctgcagtgttggaacaaccacattcctcctctaggagccactgtcctcttgggtttgctaagtctaggcccctgactccagtgagctcttctgggagttccgtttaagaatggctcggctggacgcagtggctcacacctgtaatcccagcactttgggaggccaaggcgggtggatcgcctgaggtcaggagttcaagaccagcctggccaacatggtgaaaccccgtctctacaaaaaatacaaaaaattagccaggcgtggtggcgggtgcctgtaatcccagctactcaggaggctgaggcaggagaatcgcttgaactcgggagttggaagttgcaatgagctgagattgtgccactgcactccagtctgggcaacaagagtgaaactccatctcaaaaaaaaaaaaaaaaaaaaagaacgtctcgtctgactatcatgccctctccagttttctagttttcacttttcccatctacttcattttttttggacatgctccagtttcatctgaattctctataatcctcgttatgtcattcagaaaggaagtattcactatctaccctttagctaattcagaggatgcaagagaaagaataaggcaacagttttgccctctagaagatctcactgtgatctcaaacatgatgaagtcactataataatccatgtgtgctgaaatgtcacaaaagaacacttgcacgccactgtggatccatgatgagaggccaggagacggggcatctgacaacctgtccagtcccagacagtagaggacaccttggtgaatctgccccctttcttcagagggcaatcactggacttctgggcccagaaacacaatttcctggcacactcagaatagatcatctcttgtggctgacccatattaaacaagctcaggaggcagctggataaaaccataatacaaatagaagctaacatttacatttactgagtgcttctcaggtgccagcactatgctacatgcatcagatgtattatgtcatttaattcttcttatacgtacgactctagcctgggcaacataacaagactctaccataaaatgaaaaaattagccaggcatgatagtgcacaccggcagtcccagctacttgggaggctgaggcagggacatcgcttgagtccgggagttcaaggctgcagtgagctgtgatcgcaccactgcacaccagcctgggtggcagagcaagaccctgtctctaaaaaaaaaaaaaaaaagtagaattccttatttataattgacaaataaaaatggaatatatttatggtgtacaacatgatgttttgatacgtgtatacattatagaatggctaaatcaagctaactgacatatctattacctcacatactttttttgtggttaaaaacataaaatttactcttttagcaattttcttttttcttttgagatggagtctcactctgccatccagactggagtgcagtagggcgatctcagctcactgtaacctctgcctcctggtttcaaacagttttcctgcctcagccttctagtagctggggttacaggctcctgccaccatgcctggctaatttttaaatttttggtagagatggggtttctccatgttggccgggctggtctcgaactcctgacctcaggtgatctgcccgcctcggcctctcaaagtgctgggattacaggcatgagcctctgagtctggcaagcaattttcaagtacacatgataagtattatcttaaagccactttacagatgaggaaactgaggcacaaaggttaagaaggtcacccatctattaagagaggaaaccagggccgggcacggtggctcacggactgtaatcccagcactttggggggccgaggcaggcagatcacaaaatcaggagctcaagaacatcctggccaacatggtgaaaccccgtctctactaaaaatacaaaatttagctgggcgtggtggcccatgcctgtaatcccagctactcgggaggctgaggcaggagaattgcttgaaccagggagtcagaggttgcagtgagctgaggtcgcgccactgcactccagcctggcgacagagtgagactctgtctcaaaaaaaaaaaaaaaaaaaaaagagacagccagaatttgaagctaagctgtactgtactacagccgtccccaacgttttcggcacgagggagtggtttcgtggaagacagtttttccatgaactgggggtggggggatggtttcaggaggattcaagtgcattagatttatcgtacactttatttctgttattattacattgtaatacataatgaaataattatatacaattcaccataatgcagaatcaatgggaggcctgagcttgtttttctgcaactagatggtcccatttggaggtgatgggagacagtgacagataatcagacacaggattctcataaggagcttgcaacctagatccctcacacgcgcagttcacaattgggtttgtgctcctgtaagaatctaatgccgctgctgatctcacaggaggcagagctcaagcggtaatgcaaccaatggggagcacctgtaaatacagatgaagctttgcttgctcacccgctgctcacttcctgctgtgcggcccggttcctaacaggccacagactggtactggtccatggcccggcggttggggacccgttttatactacacagaatctacactcgatacagaatctataatctacactgtatacagaatctatactcagccgctatactacagcagctgctttgttaattgacaatgagacccgtaattctcaagtggcctggaacattctcacctgcccatccatccagtgcacacgaggagagatccttgtggttcaactacctgggagctcacaggaccagaagaaggagagtctcccacctagagtgtcttaggtcatttcgtttaacctagagacaggaggtgtcctcagctgggactcaccccctttccccccggccctgagaagtacaggatggacacagccactgtggtctccaagacaccccttcctctaggctgtgacccgccaatccccttctgtctacacatacaatccagctggtcagaagttggctggctaaactgtcacgatagctctcttcccattgatcagtttacctgtcccggtggttatcaacatccatcatgggccagttcgactcttttaattctctaggagcaacctcaagggggcgcctcactggggaagctgcactatcaaccagtacatcctgtacatcatgaccaagcattaaaggagtgggctcaaaaaatgtcggggcttcgggggacagctcagtcgaggagaagtcaggttgggcccatgttccactccatagcagagtaacttcttcccttacagcccagtgtctgcaacaccctaacaattatgctattaatggtctggccttgccaggtctaagcaggtctcacctaggaatttttctctcacctcccaaaggtgatactgtacctgatgccacaatttttcttgcaagaaaacgagttgttcttagattgcctccttttgttgctttaagatcacagttgcgtttgctgagttataaccactcctctggcttgctgagtcctgtctgtgcacccatacaacaggaatgcacacacaatgaagccagtattactgccgatcaagaagtgctcagtttaagcccgaatgtgtggatctgggttggttccgtgaaacattaatttcctaggtgcactcagaattactgaaatgtaacactgtgaagaatggcccacttacgcacagctgcatctaatacagcataagtcatcttacagcaaaatagtcaagggagttttccaccttcatcaccccgtcttttcacatagcgtccagagtcctatataacctttataaccaaagtatcttgggtaacccctgaagtttattgttaatgtgatctgaaaagataaatataggtaatgaccgtctaaatgagcctgacacatgaaaggtggcgtcccaacaaatagctcagtatccaggtattaattaacctgagtctgctccttccgctgagagggagagttttcttaatcagccctagattgatgtttatggttggaggtttccttcaacacgtaccaaataggggttgcagacaacgccagatcccattaaacatctgccatctttggaacataaagtagacaatttgctttcaaagagaaaatcttattctggtagaaaattgcaaattcctttactgtgtatcctttctcatcaagcctgaattcggctttccctcaagttcactgtgatgaaatgcctggagcatctctgtgcctccccgtcttagtattgaactgttagagttacaagacaacagatgttgaaaagaattggtagcttgggaacaactgtggaattttaccatcacatttcagagtaaaagaggtgattaaggcagcccaagttagcacgtaatcctgttagttgcactataattacaagcttcaatgatgggagaaaatgccgcaattactatagtcacattccatgacaagacagatgacataattattattgtggctgtgacacccactgcatttatcctttgcatctgaagtagacagacccacacctatttctaagcaacgctggtctatttaacagtactactgggaatcaaaagcatcttggttggctttgcctgtttctcctactccaagaaaacaaagcaggattacagttaatggtacagccaggttgcagccagcatggtgtaacggtatattttacaaggtctataatggtatatttttacacggtgaaatttggtgcacactccactagaagatatcatatactgcttatcctcagtgggatcctggggacattacaggtatatacctcacctttaaattctcagaaagcactgcagggtgaactcttgtgcttttttttttctcctaacattgggaagtatttgagacccacacaccagttcctaagggcagtctctagatactttcatattatggctttcagaggatcccagtaactacttcgtactattcctggtcagtgtgggcaattcttacttgttggcggatggcctgtgtggggagaggcttccgccctgtgggtgggtcctaggccacaggcaacatcaagcttagagtgggttaggttatacctgaaggtggaaaccagagagaggagggtgggtgatatgtgtgaataaaagaataattcaacagagtccgtctctgaacccttaagtcaaatgtccatagcagcagactagccactgttaactactttcagcataggctttttttccacatcaaaagttgattgcacattgggagctaaatctaagatgcttgaaagagagttgtaatatcaccaaattaacttaagtaagagttgttctgacatggccttcagcacaggaatatcaaagccctcacttgtttagaatatgattgacctagatccaccctggaccttgacttaaccaagcccgttcaacaggtcagtgtttgtcccatctgactgactatctctcagttttgatatttcccaaatttccaaaaagaaatccataattccatcactttgcaagtttgccatgctggataagatggacactccaggcactcagctttgactcctgtaaacgagaacggcaacacctgctggtttgtggctaaatggatgccatcatatattgccgtggtttgaaagtgctgtctcccaaaagcatgttctggaaacaatgcgagcatgttaggaggtgaggcctaatgagaagttattaggtgatgagggctctgttctcatgaatggattaatgctgttatcatgggaatgggctccttataaaaggatgggtttggccccttttttctctctctgcctctctccttgcccttccgccatctgctgtggggtgacactgcaagtagcccctcaccagaggtagccctttcccagcccccagaactatgagttaataaatttctgtgcatcataaattacccagtctgtggtattctgttacagcagcacaagccaactgaaacataagcacatggggttattaatccattattcatttggctactttctagtaggacagagaagatacttgagaaacagacacgaagaagtttctcagaaattattagggcattggatgcccacaatggccctgaccagatcatccccatgaatagaagagatccctttctaagtgcaactttcattttcttcttctactactcatgttctactctttcatttaatccgaagcattttccccttttatctgatcccagttctagaactgctcatcctaataacctttcctcaatatggccagatttttggattttagccattctaataggtgtgtagtggtatcttattgttttaatttgtaattctctagtgacatgatgttgaacatgttttcatacgcttattttccatttgtatgtcatcttttgtgatgtgtctgatcagaaattttgcccttttcttttttcttttgagacggagtctcactctgtcgccaggctgcagtgcagtggcgccatctcggctcactgcaagctccacctcacgggttcaagacattctcctgcctcagcctcccgagtagctgggactacaggcgcctgccaccacggccggctaattttttgtatttttagtagagacggggtttcaccgtgttagccagcatggtctcgatctcctgacctcgtgatccgcccacctcggcctcccaaagtgttgggattacaggtgtgagccaccgcgcccggccattttgcccattttttaatgtggttggttgttttctcattgttgtgttttaagggttctctctctcttgctctcttgcacgcgctcgcgctctctctctctatatatatacattttttttttctagacgagtcttgctctgccacccggctggactgcagtggtgcaacctccacctctggggttcaagtgatctcccacctcagcttcctgagtggctgggattgcaggcacctgccaccatgcctagctaatttttgtatttttagtagagatggggtttcaccatattggccaggctggtttcaaactcctgacctcaggtgatctgcctgcctcagcctcccaacgtgctgggattacaggcgagagccaccgcacttggccctttatatattttggatacaagtcttttatcaggcatgtgtttgacaaatattttctcccagcgtgtggcttgtgttcattcccttaacagtgcttttcactgaagtcttaaattttactgtaatctagcttgtctacttttttctttgatggattgtgcttttgctgttgtatctaaaaactctttgccaaacccaaggtcacttagatttcctatgtcatcttctagaagttctgtagtgtactcttttatatttatgtctataatttattttgagttaatttttataaaatgtaaaaggtctgtgtctagattcattttctgcatgtggatgttcagttgttcttacagtatttgttgaaaagactatctttgcttcatggtattggctttgcacctttgtcaaagatcagctggctatatttacatgggtctattttggggctctctattctgttccactgacctacacgtctactctttcaccaataccacattgtcttaattactgtagttttatagtaagtctttcagtcaggtagtgtcggttctccaactttgttcttctccttcagtattttattggctattctgggtcttttggctttccatataaactttaaaatcattttgtcaatatccacaagataagatttgctgggattttggggtggggcacagcagctcatgcctgtaatcccagcactttgggaggtcgaggcaggtggatcacttgaggtcaggagttcaagaccagcctggccaatatggcgaaaccccatctctactaaaaatacaaaaattagctgctgggcatggtgggcctgtaatcccaactactcaggaggctgaggcaggagagttgcttgaatctgggaggcagaggttgcagagagccaagatggcaccactgcactccagcttgggcaacagagcaaggctctgtctcaagaaaaaaaaaaagaaaaaaaaaaaaagaaaaaaaaaaaagaagaaaatttgctgggattctgattgggatcacattgaatctacagatcaagttgggaaaaactgctattttaactatattgagtcttcttatccatgaacatggactatctctccatttatttagatgtttgattttttcctcagagttttgtagttttcctcatatagatcttgtgcatattgaatatatctgatatatttttgcccatctttttacattcaacctgagtcactttattttaggtctatgtctaatgcaaaatatattctttttaaaggttaaatctgataatctaaattagttttcccacttaacacttattattaagatagatgtatttggtattgtttctgctgtcttattttgtcttttgaaacttttacattctcttttgttttctgttgatgttccatggtctttatttcttgtactccagtaattaagaagtataggccaggcgtgatggctcatgcctgtaatcccagcactttgggaggctgaggtgggcgggtcacttaaggtcaggagtttgagaccagcctggccaacatagtgaaaccccatctctactaaaattacaaaaattagccgggcgtagcggtgcgcacctgtagtcccagctacttgggattgcttgaacccagaggcagaggttgcagtgagcagagatcgccccacggcattccagcctggacaacagagtgaaactgtctcaaaaaaaaaaaaaaaaaaaaaaaaaaaaagcgttttatctttatagccttaatatgtttataatgttaatcaatttcagaaatgaagttatattgattgattcacatctatgaaatatgaggaaattggctatactggacaattatcatgcatgttttcccccagcaactgaaccccttctctggttggaggaatgatctactttatgagtcctcgtgtggggaaacaattatttctcttaatagatctgaaaatgttaaatactcaccttcccagaatcttgcaacttggcacatgtgactttgtttctgtctatctgacacacatgtgccagactttggtgaatgatctgagggaaaagacattaggagcttttgttctggtggcagtggtcctgactagaaggttgagttcctggctcagagtgatagtggtataaactgtagcatgtagtgctgggtggtgattgcagcagttccttcctcagactgttctgcagtgtggttttgagtgctgttcccagaagatgaatcttaagcccacttctctagactttccagcaattttataagctattcaaaatccctttaataaattccttttataatcaacctagatgcttaccaacagtggactggataagaaaatgtagtatatatacaccatgaaatacaatgcagctataaaaatgaatgaaattgtgtcctttgcagcagtatgaatacagctggcggccattatcctaattgaattaatgcaggaacagaaaaccaaatgccacacgttctcatttataactgggagctaaatattgagtacacatggtcacaaagatgggaataggagacaccaggaacgagagacacactacttgaggggtgatggggggaggaaggtaagggctgaaaaactacctgttgggtactatgctgactacctgggggatgaaatcactggtgcaccaaaccctactgacatccaatttacccacttaacaaacttgcacatgtaccccttgaaactaaaattaaagttgaaactaaccaactaactaaattccttttatgtttactcagccagggtaagcttctgttatttgtaataaagactcttggactgacaggttgccatatttatactctcctctcttctccctcccctattttaatgtaagtattttctaggattgtcatagtctactactgacaaatatttatttttacatcatatagatttctgagaagaatgataaaaattacatttttttaagagtggtcatcatagttattattattttttttagacagagtctagctctgttgcccaggctggagtgcagtggcacaatctcagctcactgcaacctctgcctcccgggttcaagcgattcttctgcctcagccccccgagtagctgggaccacaggcgtgtgcctccacgcccggcttattttggtattcttagtagagatggggtttcaccatgttggccaggatggtcttgatctcttgacctgtgatccgcccaccttggcctcccaaaatgctgggattacaggcgtgagccacagcgcccagccagttattcttaattctaagtttacattgattgaataaccctgcaacttctttcctaccatgccatccccgtgtggaagttatttcgattcagtcagctggctggatcccatgttacacacatgtatgtgcagagtccagaggaggcaggagaccactcgggccatggtgctggcaagaatcctgaacaggaaggtcgtctctgagcaagtcagaggctaaagaaagagggtggcagttggcccagcgcagtggcatgcctgtaatcccagcaatttgggaggccgaggtgggcggatcacctgaggtcaggagttcgaaaccagcctggccaacatggtgaaaccccatctctactaaaaatacaaaaattagccgggcatggtggtgatgggcgcctgtaatcccaactactcaggaggctgatgcaggagaatcacttgaacccaggaggaggaggctgcagtgagccgagatcgtgccactgcactctagcctgggcttgtgacagagtgagactctgtttcaaaaaacaaacaaacaagcaacaacaacaaaaaacacaatatggcagtgactagaagatccccaaaggtcctgggaataaagaacaaccacaatgggctggtgcaagctcttcgtcaggctcccaaggtgagagaattgcttgagctcaggagttgagagcagtctggcaaacatagcgagacccccgtctctattaaattttttttcaattagctggacatggtggtatgtgcctacttaggtttgcttaggtttgacagcttctcagggtggaacttttgaaatacgaggcagtagactgcccagtcgttcctatggagttcatcatcagcctcacaggtgacctagtgttctttttggggcagctgctgatgtttgtgcattccatgagctgacacagagggacagaggtcccttttaccatttggtatcttcagtcaatggagtaagaaagttgtctgatacccaaatctgaaggctattaagagtgagaattgagaatctgactctatcacactgataaagaattgagcagaattctaggactgaatattgacccagaaactataacttggcagagagcatttgaatcccagtgatagactttggaggcagatcacctttggagagtggtgactcacactgatgtctccatggtgagtgaaatcgtgagtgttctgtctttcaacagtgctctaaacaggggtctccaaccccctgccagggaccagtaccagtccatggcctgttaggaagcaggctgcacagcaggaggtgagcggccagcgagtgagcattaccgcctgagctccgcctcctgtcagatcagcggaggccttagattcccataggagcgtgaaccctattgtcaactgcgcatgcaaggaatctagcttgcatgctccttatgagaacctaatgcctgatgatctgtcactgtctcccaacacctgtcctgtctagttgcaggaaaacaagcttagggcttccactgattctacattatggtgagtatgtaataataatagcaataaagtgcataataaatgtaatgcttgaatcatccccaaaccgtcccccatgacctgtggaaaaactgtctcccatgaaaccagttcctagtgccaaaaagggtggggaccgctgctctaaaagataggagagactgaggaaaatggcggtgctatctaatgagaacggggatgctaccagtgctgaagatctgggtgtgagtggtgccttgacaagtgctatgaaggatgcatcaagcccagtctcatacagactcagagggaatgctaatattcatctgatggacatgaagccctctagcacagcaggtccaacagcacgaagacttgttggttctgaatgctctatagcgatggaagctggatttggagataactttgtcttgaaagcagtttttttaaagtattattattattattgaaataaagtcttgctctgttgccctggctggagtgcagtggtgagatcataactcaaagcagcctctgtcttctgggctcaagtgatcctcccacctcagcctcctaagtaggcacataccaccatgtccagctaattaaaaaaaaaaaatttagtagagatgtggtctcgctatgtttcccagactggtctcaaactcctgagctcaagcaattctcccaccttggcctcccaaagtgccaggattacagacttgagccactgcacccggcataaaaaaatgtttaattataggactatatgtttatacaaatatatgtgtacatatatacacatatatgtgtatttctataaaacatacatgacatcaaatgcatcgtcttaactatttttaagtatatagttcagtagtattaagtattttcacattcttgtgcaactatcagtaccatccgtctccagaacttgcaaaactgaaactctgtttccattaaacaaccctccattctctccttcccccaggccctggagaacaccattctcctgtctgtttctatgaatttgactcctctaggtacctcatataggtggaacacaatattttgtctttttgtgcctggcttatttctcttagcatagtgtcctcaaggttcattcatgttgtcccacatgtctgagtttccttcctgtttaaggctgaataattttctgttttaagtatacactacattttgtttatccatttatctgttgatagacatttaggtagcttctatgccttggctattgtgaataaactgctattaatatggatgtacagatctctcttcaagaccctacttccaattcttttgagtctattcataggtgatacatggattgtctcacccgatcccatttctataatattgatttgggctctgtggaatcctgataaataagcaacaatgaggaaggggtcccaggttggggagaacaattgttctgagagacggctaaccacaaacaggcccttgcacaacatcctgttccctcactctgcacgtagccccagcagcaggactgtaactgcacgaaccccctccagcatgaccctataaagcttccttccagcccctgcctttttggagacagtcccttttctgctgtgctgcccgttgcttccttgcaacatactttccttctaataaatctgcttttttttttttaaacctatgactgccttggcaaattcctttagcactcatgatccccgctctagtcatcacacctgcaacaggccctgcatcaaaacaggtgactgagctgttccaagtacatcaagcccatccttcagtgccttcaatgcctcctatgactcagattgtgtgtggatccagccatgtgcaagaccctcagcccctgctcgggaagaccttttgactgagcaggcattttctcagctttcttatggtcttaatgtatattatcatgtgtaaattaacataattatgcacatctgtatctcctttagtgaaattcaatggaataaaataaaataagtttgctaaagaaaagcagcacatatttgcattacatttaaacttctgcataattgagaatatatctatgttgccatggacataaatggccacttggttgggtagagaattcattgtagatgctgtttctccttgggctgacatcttcagaactgtggggaagtgttgtccagactgatattttcctcctttgtgggtgaggcactgtagtgtaatgatagtacccaaggttctgggtttgtatccttccttcatcaaatgacaactctggacctcttttctttttctttcctttttttttttctttttttcttctcttttcttcttttcttttctcttttttgagatggagtcttgctctgttgtccaggctggagtgcagtggtgtgatcccggctcactgaaaccttctccgcctaggttcaagcaattctcctgcctcagccacccaagtagctgggactacaggtgctcaccaccaagcccggctaatttttgtatttttagtagagatggagtttcaccatgctggccaggctggtcttaaacttctgacctcttctgatcctcctgccttggcttcccaaagtgctgggacaacaggtgtgagccactgcacctggcctgggcctgttttcttgtctgtgaaatggggtactgatagcaccaacatctcagggctggtgtgaaaattcaagcacctaacacatattaagaatgtaccaaggctgggtgtgggggctcacgcctgtaatcctagcactctgggaggccaaggcgagtggattgtttgagctcaggagttagagaccgcctgggcaacatggcaaaacctagtcttagctatttgggaggctgaagtgggaggatagctcgagccgggaaggcggaagctgcagtgagccaagatcacgacactgcactccagcctgggtgacagagggagaccgtgtctcaaaaaaaaaaaaagaatgtaatcaaagttaggggtatttgtcctaactgactgcttcttctgcctatattcttttttttttgttgttttaagatggaattttgctcttgttgcccaggctggagtgcaatggcacgatcttggctcactagattcctcatgacctctttccttgtttactgaagcagtgtttgaacgcctcccaggttcaagcgattctcccacctcagcctcccgagtagctgggattacaggcgcccaccactacgcccagctcatttttgtattttcagtagacagggttttaccacattggccaggctggtctcgaactcctgacctcaggtgatccgtccgcctcggcctcccaaagtgctgggataacaggtgcgagccactgcgcctggcctcttctgcctatattcttaatgggctctttattattagtattgcttttgttttgctttttgctattgacttatttgttgatggagagatcactctttccttttgagattaagaccctcagctgtatttgtgtctgtgtcgatcatttctctcacactcttttctggaatacggcaagcagtttggacctgcagattcaggtcttcctttatttaatgaagctgttttatgttatatcctgaagagtattttctattccatttattctctctgccaggaatattcgcatacaaatgtgagaatgctcttgtcagtctggatttctatcagcttctaattgcttcggtctgacactccatctgtttcttttgtttcctgtgcaccttcctgaggcctgtctccaggtcatcactgtggctttccacagcatgtgtgccactctccactctttccagtggtgctcccacctccctccaattctttccttagcttttccacctccctttccaactcgttagtttcacctcttcttttttttttttttttttttgagacggagtttcactccgtcactcaggctagagtgcaatggcatgaccttggctcactgcaacctccgcctcccgggttcaagcgattctcctgcctcagcctcccgagtagctgggattacaggtgcccgccatcatgcccagctaatttttgtatctttagtagagacagggtttcactatgttggtcaggctggtctcgaactcctgacctcaggtgatccactccccctctcagcctcccaaagtgctgggattacaggcatgagcaccgcacccagtctaaataaatttttaaaagacagggtctcactctgtcatccaggctcgagtgcagcgccgcaatctcggctctctgcaacctcaacctcccaggtttaggtgatcctcccacatcagcctctagctaggtacatgctaccatatccagctaattatatatatatatgtgtgtgtgtgtgtgtgtatatgtatgtatatatgtgtgtgtgtgtatacatatatatatacacacacacacacacacacacatatatatatacatacctttttttttttttttttttgaagagatagggttttgccatgttgcctaggctggtttcaagctcctgtgctcaggcaaacctcctgccttggcctcccaaagtgctggaattacaggtgtgagtcactgtgctggccttaaaatattctacaatactacaatagaaaattgggtaaacggtaggaatagccaattagcaaaagaagaatttaacatacaaaattagtttaaccccagtaacagtcaatgaaatgtatgttaaaataacgaggcgtcagcaatcaagagatggtatgacataaaggttgagagcgaaggctctggagacacactccctggtttcctatccctgggctctcatcacttttcagctgctgaattttaggcaagttaatgaatcttcatagacctcagtttcctccttcatataacagagtacccacttcattggactgctgtgagaattgaatgaatttaatgtgacttgttcagaacaacgcgtattaagcactcagtaaatgttggccgctattattatcatctgttacatttgcatggcataatgaatggtgtttggggggagaatgtgggaaaacacacacattactgataaaaatataaattggtatccctttctatagggaaatttgatattgactcaaacactttcttgtgtatacagtcatgtgtcgcttaatgacggggatatgttctgagaaatgccttgttagatgatttcatcactgtaagaacatcacagagtgtacttctacaaacctagatggtctatcctattacacaatagggtatagcctatagattacagggtatagcctattgctcctaggctacaaactttttaaatgttaattaattaactaattaattattttgagacagggtctcactctctcatccaggctggagtgcagtggcaggatcagggctcactgcagcctcaactcctgggctcaagcaatcctcctgcctcagcctcccaagtagctgggactacaggtgtgcaccacatccagcttacttttttgaatttttagtagagacaggatctcactatgttgcccagcctggtttcaaactcctgagctcaagtgatcctcctgccttggcctcccaaagtgctaggattacagaaatgtgactgtactgaatactgtaggcaactgtcacacaatggtaagtatctgtgtatctaaacagctaaacagaaaaggtaaggtaaaaatacagtactagatatcttttttttgagatggagtctcgctctgatgtgcagtggcaccatctcggctcactgtaacctctgcctcccgggttcaagcgattctcttgcctcagcctcccaagtagctggaattacaggcgctcgctaccacgcctggctaattttcatattcttagtagagacggggtttcaccatcttggccaggctggtctcaaactcctgacctcaggtgatccacccaccttggcctcacaaagtgctgggattacaggcatgagccaccgtgctcttttttttttttctttttttttttgagacagagtctagctctgtcgcccaggctggagtgaggtggtatgttctcagctcactgcaacctctgcctcctgggttcaagcaattctcatgcctcagccccctgagaagctgggactacaggtgcgccaccatgcccagctaatttttgtacgtttagtagagacagggtttcgccatgtttcccaggctggtcttgaactcctgacctcaagtgatctacccacctcggcctcccaaagtgctgggattacaggcgtgagccaccatgccgggtcaaaaaatatacactactagaatcttatgggaccaccgtcatatatgcagtctgtcgctgactaaaacagtttttatgtagtgcctgacagtatatatctctcttttggccaagagattttcagtccttaggaatttatcttaaagaaataatcagacatgaaaattttatctaccagtatgcttgctgcagtgcttccttaaaagtaggactcacaacacatgcacatgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctgagcaaactatcgcaaggacagaaaaccaaacgccgcatgttctcactcataggtgggaattgaacaatatcgcttgggcacaggatagggaacatcacacaccggggcctgtcaaggggtggggggaggggggagggatagcattaggagaaatgcctaatgtaaatgacgagttaatgggtgcagcacaccaaatatggcacacgtatacatatgtaacaaacctgcatgttgtgtacatgtaccctagaacttaaagtatgataaaaaaaaaaataggactcacggcccggtgcggtagctcacacctgtaatcccaacactttgggaggccgaggtgggcggatcacgaagtcaggagatcgagaccatcctgggtaacacagtgaaaccccgtctctactaaaaatacaaaaaattagccgggtgtggtggcgggcgcctgtagtcccagctactcaggaggccgaggcaggagaatcacttgaacccgagaggcggaggttgcagtgagccgagatcgtgccactgcactccagcctgggtgacagagtgagattccatctcaaaaaaaaggaaaaataaaaaaagactcacaattggaaataactgaaatgtctaaggataggagactggttaattattgtacatcgggggaaaatagatattaaaaatgacattttaggagaatatttcctgaccttgttatatgatcacaatatactgttcagtgatatatcaggttataaaaaagcaataagtgtacattatggccccagttttataataaatgtaaaacaaatatagatggaaaaacatcaaaaggtagtggttatagaccattccaattatcctctttatacttgtcagcatttttcaaaaattttaaaaataaacaagtacctaatctcagcactttgagaggccaagatgggaggataacttgaggtcaggagttcaagcctagcctggacaacatggtgaaaccccgtctctactagaaatacaaaaattgtccaggcatggtggcacaggcttgtaattccagctactcgggaggctgaggcaggagaatcgcttgaacccaggaggcagagattgcagtgagccaaggtcacgccactgcactccagcctgggcaacagagagagactccatctcaaaaaacagcaacaacaaaaaagcaagtaccattttaatgaacagagaagtagtatcattttcaaaacaagcattaaaggcccctgaaaaggatatgactttttcacattctcacttcaacccaccagatgttctgcttctttgttggaagcgctttaagtaagctccatgcttaggtatgtgttcgagccactctcatttatttatggttttaaataaattatcaacggaataaagagagtatatacgagaaatatctcaaagacttgtaaattcaacttttgtgtccttgcatttcctatttttttgattatttgttctcctttcttttaagcaccaaattatacccttttaaaaaatagctctttctctttttctgttttctctacatttttcttagtttttatgaaggaagattgttaataactgccagtatctgtcacgacacaatcctttctttcttttcttttttgagatggagtctcccgctgttgcccaggttggaatgcagtggcgcaatctcagctcactgcaacctccacctcctgggttccagtgattctcctgcctcagcctcccgagtagctgggattacaggcacacaccaccacacccagctaatttttgtatttttagtagagatgggatttcaccacgttggccaggctagtctcgaactcctgacctcgaatgatccacccacctcggactcccaaagtggtggagttacaggcatgagccactgcgcctcgccacaatctcttttctttgatgtcagtatctttctgcactatcgcactctaaatacagagggtccctgacgtacgatggtctggctgaatgattttttcgaatttacagtggcagaaagcaatacgcattcagtatgctcctccacttcccatggggtcacatccgcataaacccatcgtaagttgaaaatgtcgtaagttgaactttcaatttataataggtttattgagaggtagccccattgtaagtcaagggccatgtgtagccagttctcctgcgtttcttgggcttcaacttttagtgcatccatcacctgaaattcctctcttcctgcactcatgttttcagtagtctatagaacgcaggcccaacaatatattgatctgtcaatactcagcaaataaagcctgtgctcacaaaattaatctcagcctaagggcagcccttgtaggaattgtgagcacacccaccccacggatgttgaaattatctcccaggacaaatgagactgggcagaatgttccttggccagttttccttggccattccatcagttgcttctagtccctggctgagagttgggcttgctcaagggtgtctgtccaccccagagcctcatgagccacagacataggattgacccaatgtcagcaatttccctttcctgtggggcaggagaatcagggcaccctgagggatggcacgtggaaggcagcgtggaacccgcctgagagcctgtgtcctgactctgcctgggagcgctgcacttcacccttgggagaacgccttctcagtggctgaactctgcattgtggctgtgcaggctggcttcagacactgttttctccagtgaggcctcttacactctgctcagctcagacctgccataaccgcttgtcggattttctctatttaatgatcaatgtcatatatgtactttttttttttttttttttgagacagagtctcactctgttgccaggctggagtgcagtggcgtgatctgggctcactgaaacctccgcgtcccggattcaagcgattcccttgcctcagcctcccaagtagctgggactacaggcgcgtgccaccatgccgggctaattttttttttgtattttagtagggaggggtttcaccatgttggccaggctggtctcgatctcctgaccttgagatctgcctgcctctgcctcctaaagtgctgggattataggcgtgagccaccgcgcccaaccatatatgtacttttctaatagagttttagattgtttgaacttctgatgggtgagaaaaagaataaggctatgatggtattctttcccttagaacccatatagtttccaaaattcatctttcatgtgctctttatttcttttttagaaacctgggtattattttccaagctttgtgctttttgtgaggctatacaggttctatggtgaatcctcctcatgcctgcgacaacctggaggacattacttgtttttagctgctgataagagtttgcaaagaacacacatctttgttgggaaatgctttgatgtgcttctaggcaagatgaagagtcacatggagtgggggtggtaatttgggagaagggccaagtagcaggggattctcgataaatattaaatgaatggaggtaggaaggaggtctctgaaccacactgtgtgtgggtttaagatcttgctgtgggctttgtggtgtaatgcctcaatctatatcccctactgaagtctatatttgcacttgtgcttttgtgcaaatggggacaagcagaacttcaagacaataatgaatatttcagctacgtttttcctccatgaatcgtgcaaagctctctgaattggcactattactctttcttacttctgcaaccccagaactgcttaatgcagttatattttcctttctcttcccagtgacagatgtccccttattttcctgggcggcaaatgccttcttttccttccttcctccttagaaactctcctgagcacaataagctacagagcctggtggtgggccctatggttggctacataccatgccatcccgggggctcccttttggtttcctgctggtacctgccctcgcctgggatgtcctctttgggttcccatctgccgtgctctcacctggaagccagctctgtgggcctgggagttgccacgattcctaccatggaccctccagctggttcccatgcagcctgccctatcgtcgtgtgcacattcacctgctaggcattctcactatgcagtcagtatgggcctggccttttcctcttccttggaaaatccatctcagtgttttctttttttttctttttaggtagagtcttgctctgtcacccaggctggagtgcaatggtgcaatctcagctcactgcaacctccgcctcctgggttcgagtgattctcctgcctcagcctcccaagtagctgcggctacaggcacgtgccaccacgcccggctaagttttctatttttagtacagatggggtttcactatgttggtcaggctggtctcaaactcctgaactcgtgatccacccgccctggcctcccaaagtgctgggattacaggcttgagccactgcgcccggcccatctcagtgttgtcatctggccctggtgtttctgacatggtgtgtgcgagttcagtggattctaaaaactgctcctctcctccttccccagggctgccctctgtcatttcctatccagcctccctctttccttcctcctctctggcagtaacctcgtacccatcccagaaaggccattgcctttccctggtgacttcctctctcttccctcctcaaggtccttgacgaggtcatcgggagtgtccttgacagctcccctttctttccacattcgtatagtctggctgataccaagatgcaccttttctttttttttctttcaagtcttgcatcacatagatttttctgcaaagccacactgtgccctgaaaccagggatgcctagggctgaaaaccatgtgtgagcttcatactcattagggtgactattattaaaaaaacagacatcactagatcatcagggaaatacaaatgaaagctacagcaagatatcacatcaaacctgttaggatggcaattatcaaaaatacacaagatgacaagtgttgctgagtttggagaaaagggaaccgtggtatgccattggtgggaattaaatttagtacagccattttggaaaactgtggatgtttttcaaaaattaaaaatagaactaccataggatccagcaatcccactactaggtatataacccgaggagacgaaatcagtatgtcaaagaaagatctgtgtttctgtgttcattgcagcattagtcaaaatagccaagttatggaatcaacctaagtgtctatcagcgaatgaatggataaagcaaatgtggtatatttacacaatagaatactactgagccctaaaaaagaaggaaatcttattacttgagaaaatatgggtaaccctgaaggatattatattaaatgaaataagccatgcactggacaaatactgcatgatctcacttatatgtggagtgtaaaaaagtcaaatttatagaaatagagagtaaaatggtggctacctgaggctgtggggtggtgagattagagagatgttggtcaaaggacacaaagtttcagggctggctgcggtggcttaggcctgtaatcccagcactttgggaggccaaggcaggcggatcacctgagaccaggagtttgagaccagcctggccaacatggcgaaccccgtctctactaataatacaaaaattagctggacgcggtggtgcacacttgtaatcccagctacttgggaggctgaggcagaagaattgcttgaacccgcgaggcaggggttgcagtgagccgagatcatgccactgcactccagcctgggtgacagagcaagactccatctcaaaaaaaaaaaaaaaaaattcagttagaagaaataaattcgagaggtttattgcacatcatggtgactacaattaataacaatgtattgtatacttgaaaattgctaagagaataggttttaagtgttctcaccacagaaaactaagtatgtgagagaatacatacattaaatggcttgacttagccattccacaatgtatgcctatgtcaaaacttcatgttgtacaccataaatatacaccatccccctcagtactgtcgtcatgatagtgagtgactttaatttttacttgtcaaagtaaatacattaataaaaaaaaaaaagtaaatacattaataaaaaaaaacccagaaaacaagtgctggtcaggatgtggagaaacgggaattcctgtgcactgctggtgatgacgtgacgtgatgaagcccctgtgtaagcagcgtgacagttcctccaaaggctgaacataaggccgggcatggtggctcaggcctgtaatcccagcacttagagaggccgagacaggcagattacctgaggtcaggagttcgagaccagcctggccaacatatagtaaaaccctgtctctactaaaaacaaaaattagctgggtgtagtggctcatgcctgtgatcccagctacttgggaagctgaggcaggaaaaccacttgaactcaggaggcagaggttgcagtgagctgagatcatgccactgcactccagcccaggcaacagagtgagactccatctctcaaaaaaaaaaaggtaaaaaggttgaacatagagttaccctatgatccagcaattccacttgtgggtacccaaaggaaccaaagtaaagactccaacagatacctgcacacccatgttcctaacagcattatttacaatagtccaaaggtggagataacccaggtgtccatcaatggatgaatggataacaaaatgtggtctatccatgcaatggaatacaactcagccctgaaaaggaatgatgttctgatacaggctacaacatagatggatcttaaggacgataagttaagtgaaataagacaggaacaaaaagataaatactgtatgatcccacttatatgagatacctagtgtagtcagattcacagaggaaaaaggtagaacggtggtcaccaggcatgggcagggcgaatggggagttggcactgaatgggtacagagtttctgtgtgggaagatgagaaagttctggaggtggatgctggtgatggttgcacaatattgtgaatgtacctaatactgatgaattgtacatttaaaaatggttaaaatgataaattgtatgttatatatattttaccacaactaaaaaaattaatgttcaagggtgtccaagcaagaaaaaaacaaaaaccacccatgtgtgctcacgcatctttggcacagatgcggttcctaggttcagctctctcctcaggcattgtctcttcaatgacaacattctgtttccaccaactctgtttctgaaccaaatctgacacagctgtcactggcctactccctggaattaccacaggatctgaattagcctctggcaggccccctgaggaatcttgctttcacgtttccattatggtcagcacagcaacatggcggcctatcccgttttttgtttttttttttttttttttcctgagatggggtcttcctctgttgcccaggctgaagtgcagtggcacaatcttggctcactgcaaactccacctcctgggtttaagtgattcttctgccttagcctcccaagtagctgggattacaggcacacgtcaccagacccagctaatttttgtattttttagtagagatgggttttcaccatgttggctaggctagtctcgaactcctgacctcaggtgattcacctgcctcggccttccaaagtgctgggattacaggcgtcagccaccacatctggcctgcctatccctttgattgaatatcacctgagtaactgatatggtttggatctgtgtctctgcccaaatctcacgtcaaattgtaatccccagtgttgaaggtggggcctggtgggaagtgattggacatgggggtggtttctcatgaagggtttaaaaccatctcccttggtactgttgttgtaatagtgagtgagttctcaagagatctggttgtttaaaagtgtgtagcaccttgggaggccgaggcaggcggatcacgaggtcaagagattgagaccatcctcaccaacacggtgaaaccccgtctctactaaaaatacaaaaaattagccgggcgtggtggtgggcgcctgtagtcccagctactcgggaggctgaggcagaagaatggcgtgaacccgggaggcggagcttgcagtgagccgagatcacacctgggcgacagagcgagactccgtctcaaaaaagaaaaaaaaaaaaggtgtgtatcgcctcccccttctctctctttctcctgctatgtaagatgtgcctgcttacccttcaccttctgccatgattttcaatttcctgaggcctccgcaccctccgccctgagaagccaagcagatacaggcatcatgcttgctggaccacctgtggaaccacaggccaattaaatctctttataaatgacccagtcccagggatttctttacagcaatgtgagaatgaactcctacagtaactcatttgtctttgactttcctctttcttttagtgacagtgtgtgtgcctaagtgactcttgaagaagccttcattcttgaagacacccggtcctcacaggggctcctggggcggtgtctgtggcaggtgaagatgctattgcagaatttatcttccttgccagaagagaacgcctgggcaaaggagaactgccttatagcccaaactggggcccactgtcttttcaggtctctggccatggggcttgacagctggattctaacgtctctctccctagtgcctcccacgtttactctccatgttctgttgattttcttggtgtgtttgcctccccgatcgcatctttgctgtctgctccacactgtacccgatttctgcccctccttgcctctcttgattactcagagcttcaactacctcctcacctctgacaactccgtctattgcttacaggttggttcacctcacacacctgtcacctcatggctgtggcttccgcacctgtgtgcatggcgccctcctcccatagctctcttcccagcacaacctgcagctcctcccgctgcccagctgctccacacgagccgtgattagctcacaccggcctttcctcctccactatcagctcagagccagccatagctcacaactctgagaagtcttccctgagccatacggaggagactgtcgccttcacatttctctcccaggacccttcaagtatagattaggtgctcagcaatgcctttcactgcagtcctcatcctttttcctgtctgcacttctggagcacgggatgcctgcagctttcatttgaaacccctttctatgctattgggacccgctgtgtcttagaattgttttctgggttctaaacttgctccctcctctagtctagagaccaaggactgacatgtaatttgcagttggtatcggtatgtatgagatgtagatgctctagtaacatgggtccggtgatactgacttacatcacgctggattccttccttgcttcatataccctcatgtaactttccgtgcatattttctgcctccttggagaggttgtacccccagagctccaggggaaaagaataactgtccacacagaggtgagtattggtgctttctagccatacactagcatgaggggaggggtcagggaggctctgtccatagaaggcttcaggagtcgcccgttgccatggattctgtgttttttgaatcccagatgcccaggtgagacctctgatttgtgttccccaagaccacagacacatggagcttcctggcatcaggttcccgacaccagagttggggttcctttcaactctattacagtcaacgagcgtcatgctcacggactcgttcagagccacatgctttgcctggccttctgctcacctctgagtggcatctggagaagaggtggcttcatcttgctgcagtcctcccagcgtggagagacctgcactcatcagtgaaatgaatacaacgggaggtgtctggaacctttcttcattttcaccaaaggaatatttgacacacccaggcatggttcagagctccaccctcaacaataatcctgtcaaaatatccgatgttgttgaacctcaaaggcactgtatcacagcagaaaagtgattgatctcattgctaaactctctttcttgcttattggcatgacaacggagctaaatagagccgagatgaattatgagtctatttttggagactccttatggaattcatgcacactgtgtattttgcatcctttgaatccttgggcacacttagaactgtgaagcaaacactcatttgtaaatgttacagctgccaaggttggctgcatgctctgctgggtgacgtgttaactctcacaagtctgctttggaagcaggaggaatgttttgagctgagcttcgggcggagggtggggctgacgcatgcatgcttaccttgaccctgtccatacaggcttccatctttagctgctccacagctttcctggcttgggagatgctagtggtgctgttattagacatgccctctttcattctactgcccctagaagtaaccaaagtaaaagggttagaagagctgctcttccaagggtaggggaaccccacctcccaccacctacagcttctctgtccaagccagggagcatctgggagcatggacagcatttggtagaaaaccctcctgggataagagaaaggaatgcctcattcgagtaagaggagcaagacatgatgcttttgtttggaaaaactttctcagtcccggggacagtgagaagagaacagaaggttccagaatgacttttccatcacccccaccactgccaccaccatcaccaccacgaccataagtaatgcttggacattcgtatagtgctttgagtcatcattcactttcacacacgtttgctcattcattgctctagcagcccatacagttggtgggacaatattaatttctattttgcaaaggaagaaagtgcaaaaatcagagaaattaaaccaatagccaaagatcctacagccaacatttgtggatccagaactcaaactcaaagctttgaagcctagccgagtgtctcaaatggcctctcctaacaatctatggctcataacacacatttctaatgaataaaattgctttattaattttaatttgttgtccttccaaaaagtttacagactttgtgttgagagtttgttttcaacaataaacacacgcacaaacacacactctctctctctttcttccctatcccaagcatagatttattttctagagggaggcagaagaaattctccctaaccctacacacattgatgccccgtgactaagaccagtgtagtgctacctgtttcacagaaagcatgtgctacacacatcacaattgcaattgccccgtctaatgagaatctgcttcaaaggaagcctaaaactaaagcctgagagctggggacaggtcactgagagcagaaacacaagtgacactggctcccaaaggtacagatgaggtgggaagaggccctggccaccatctattattcgtctgcttctgtttatattttatttcagttttaggtttttttcccacctcacaactgttggactttattgtattaatttaattgagtatgtaaagcagcaaccatactttcaaagttaaaatgatgcaaattgatattcacacaggtgtcactttcactgcccattccaatccttttctcccctcccacctacctcctatgggcaaccaatcacactggactccagtctattctttcctatgcttcttttttctccttccttccttccctccctccttcccttcctccctccctctggtcttccttccttcccatcacgttggactccagactattctttcctatgcttctttttccttttcctttcctttcctttccttccccttcccttcttccttccttccttctttttgagatagggtctctgtcatccaagctgtaatgcagtggtgcaatcacagctcactgcagcctcaaactcctgggctcaagcgatcctcctgcctcagcctcctgagtagctgagactacaggtgtgtgccgccatgcctggctaattaaaaaatttttttttgctatgtttcccaggctggtcctgtgtttattttcttagaaagtaagcagttacatatatgttttctcatttctccttctttcttacacaaaaagataacgtgtgtgtgcttttgaactttgtttttatatttagcaatacattttagaaagcaccacatattagttcactgatatgcaaaaaagatcatactcattctttcttagaactacatactacagtactccactgtgtggatatactgtatatttttcaatccatatatttacgggcatttacatctatattctcatattattgtgggggtgtgtcttcaaggtacatttctggaattactgggtcaaaggtaaatgcatatttacttttgtgatatattaccaaattctataaggtaacattctgataatttttgcatcaagattcttaagtaattttggaattcagtactattcttaagtaataaattaagtcatttaatgctaccttcatctggtttaaatatcaatgttatacttgcttcatacaaaacatttagaatttttaagaaattttctatttggccagtaggttagtgtatgggacccactctctctgtgggttttaatcacatatgaactaattctctggcccagaaaggcataatggcaactacatttgtccaaaggcagtttttgaaaagtaaaatattctcgttagaagacagatcagccacccaaatcagagtttaatagatgtgtgtccttatcttagtttggaactttaactcaacaacaagggaaggagaatcacgacaagttgggagctttgaaatccaaggaacatccccttcatcccccactcagcagaactgtgcacgcgttcctgcacatgtgttggtgtgtccttgggtgtgtctgtatgtgcccacgtgcctgctcgtgcaggccttgtgccagtctgtgtgtggccatctctccgtgtgtgtgtgtgtgctgatgtgtgtctgcgttgctgtgtgtctacacaaaatgagggaggagacacagtctagttcccaacccttcccagctgatgcaatgaaaaaaggactctgatgtgatttggatgtttgttccctccaaatctcatgacgaaatgcgattcccaatgtgggaggtgggtcctggtgggaggtactggatcacggggccagatcagtcaggaagggctcagcgccaccctttggtgataagtgaaagtcactctgagttcatccaagacctggttgtttaaaagtgtgtgtcgccttcctgctgtctctcttgctcccactcttgctgtgtgatagtatggctcccccttcaccttctgcatgagtggaagcttcctgaggcctcaccaggaacagatgctggctgccatgcttcctgtaccacctgcaggaccataagccaattaaacctctttcctttagaaattacccagtatcaagtattcctttacagcaacacaaaacagcctactacagaccctacagtgactgccttcaaatcttgatcctgctctccccattctagactccatccctctcgccccttgtctttgacttgggcatttaggagttgggggaggttcaggggaggaggaggtagagtttgggatcagcaggggtgaagccaagaggacatggagcagggcaaagggaggaggggagggctctgcactgtgtgtgagggagtctgtggtgagtaggagtgtgtgaaagtgtggggtgggggtgagcgtgtgagagtgtgtgggggtgagtgtgtgtgacagaaagtatgtgtgagggtgtgggtgagtgtgagtgtgtgaggtggggtgtgtgtgatgacagtgtatgtgagtgtgtgtgaaggtgtgggttggggtgtgtgtgagggtgaggggtgtgtgtgtgtgagagtgtgagagcatgtatgagggtcaggggtggggtgtgtgtgagtgtgtgtgtgagcacgtgtgtgagcatgtatgagggtgaggggtgggggtgtgtgtgtgagggtgggtgagcgtgtgtgagggtacagggtggggggtgagtgtgagagtgtggatggggggtgggggtgtgtgaatgtgaggtgggtgtgttgtgggtgtgtgtcagggtgtgggttggggttgtgaatgtgggagggtgtggggtggcggtgagtgtgagtgtgggagggcatggggtggggtgtgtgaatgtggggtggagtgtgagtgtgggagggtgttgggtgtgtgtgtgactgtggggtatgtgtgcgagtgttgggtgtctgtgtgtgagggtgtgtgtgggtgtgggtcagggttcagggtgggggtgagggtgagtgtgggagagtgtggggtgggggtgtgtgtgtgtgtgaaggtgagagtgtgaatacaggcacgtctcagagcatgcggggtgaacgtgtgtgtaagtgtatggagtgtgtgagagggtgtggggggtgtgtttgtgtctggagtgtgagtgtgtgggtataagtgtgagtccttgaggatgtgtgcacatgtgcacaggtgggtcatgtggcggggagggaacagctaacgttaccggggaaagcagcagagccgactctcagtcccgtcaggcccctgcagctgcgcccacctctctccctcccaggcgctgttcagacggccctgatccctcagcccttcctcattcttccgctgttcaaaagaagggctcgttttccacatgccctaccctctccgcagaggagagttctggctggaggcttcctgtgggaaggtcccaccagcgcactgtgctttccttgttgtgcgctggagataaaataagcgggtgggtgaccctctgggggttccatccctccatggcctccctctcaggccctccatgtgcgtccactctccagcccatgtctgccacccacagccgaggcccctggacctggcccccagcgggggctgtgctctccgaccccagcttctccctcagccccttctctgctgcttcctcctcccctggctccatacttagcctcaacagcatgacccaactaccaccactgtctcccaagagccgtctgcttctctggccctttcctctgtccctaaaacctgcttcggtatggacccaactcctcccctctccacactcacgaaggggctgctcagcgctgctggagagaccccccccactaaactctgcccatcagacatccacaatccagcctctgcgaggccctcagagctacctggcaataggactccttgccccaaatcatctccccctcccttcatcctcttcttccagtcttcatcacttcctcatcacctctgacctttcctcctcagcagaggacctcagcccctctgtctacacagaatggccattagcagagaaccctccttaatgttccccaccccacctactccactccacacccacatccatccttgcctccactcagggcagcagctcttcctccacagcagagcctgtaggacaccacccacagctgctcccgacttgctgccctgccggcagggccctccttcctccccaggggctgacaatggcagactcactttcttgcctcccttgctgtaaggccagagcacgcgtgtcaggaacatggctgtgctttggtcaaggataggctgaggtaaacatccagagtgactcagcaagtttagagcgcaggcgtataactccacttgtcatcacagccatatagccataacatcggaaggctcatcatttggctctaagccactgttgtttgtaaaagctattattgccctgctgacactgtacaggcatgctggcgcccagagaaagagccaaagctgtccattttgcaggtagacagggggagccagggcacagcacagttcagctcgtgcccagagagagaaagagttaagctgctgaccccgaaggcaggggagagtcggccatgcagctatgtgtgggagctggctgctgagaggagccacaaagccagagcagacagctgagtcaaggcggacagtgtgagagagctggtatgagtcagctgctgagagacctgttgagtaaaactacatttcacctgcttatggccccacgagtgttccttcagctacctgcccatccgcccactcccctcgaacctcagcatgggctggaacctgaccccaagcagggcatttggtatagttgtgaacctgacaacgtgaccttgtcctcctcaatgggacatcaggggaaatctgcagggactcatagggagggttttcctccccgacggagggacaaggggagaaagctctgtctttggccaccttgagttgtgtttgcagctgccagagccataaaaccactggggaatcaaccaaggacacggtcactagtctagtggagaaaatgacctggatccttgagctgggtgggtccttggaagtctattcctgatccttgaaatgagataatgtactcctcatggttcaggccatatttgttgggtcatctgtcacttgcagctgaaggcatcttctcagccaaggctaacacttcacaggtcagtagaccgctcccctccccaagggatctgccctacactcacccctccatcctgtaatgtccacgtctctggcgcttttcctcctcagaatatgcaaatatatttatgcaatctgcacctgaccatcttaaaacaagcaacaacatcaacagtcttccctccctgcaatcttctgcattcttgcttaagaaggtggagaggctgggtgtggtggctcatgcctgtaattccagcactttgggaggccgaggtgggtggatcacctgaggttaggagtttgagaccagcctgaccaatatggtgaaatcccctctttactaaaaatacaaaaattagccaggcatggtggtgggtgcctgtagtcccagctacttgggaggctgagacaggagaattgcttgaacctggaaggcagagattgcagtgagccgagattgcgccactgcactccagcctgggtgacagagtgagactgtctggaaaaaaaaagaaggtggagaggtaaccacagattcccctgagaggcccctcagtaactaaaggaagagattctaatgtaaggatgaaaagccgtctttcgggagcactgggtaaacaggcctgctccacggtctctgctctgctgccctcggctcaccctgattctgtgtctaggacagtcacccttgttgcccagagtgatccttaagcgatttcatgtgtgcgtgtttgtgttttctctctccaaggggctgctctggcttctcccagcactgtggccctgcacacctggacgtccgtattttacaatctcccaggctgattctggcccgtaccaaaggagagcaccactgctggctgtgagccacttctacttcgtgattccttagtgtccaaattaccttgcatgggacgcataggatgtctcatgtaccttaggggctgtctcaactagtcctttttgaattttaacgtgcatatgaatcacctgaggattttaaaatgcagattttgatcgagtggctctggggtaggggccgagatcctgcgcttctaacgagcttcgtgaggctgctggtccacggaccacactttgagtagcaaggctctgaatcactgactgttggtattgcaggggaacatggaggtccggttccaatcctcttatttttcagataaggaaatatattcaaggaggttaggtaacataatttcccagcgctcctcagcaggagtggaaggaagcactgctccgccactgctcctggctcattacccaccttggcctagtggcgcttaggatttcatcccccacacttggtctgtcctgctctcctggaacagactcatcccctgggtgatcctaaccttgcttaacctgggagtgaggtgtcaggagggagccccttccctgaggtgggcaaaaaaagcaggaaatccctggtgggggagaaggtaatggcttttgccaatggtgctgaagacaaccacatgctttgaagatagagccctataagaaggtttcggaggtcctgcttcccctacctggccaggtaccctttaggctccacctgaataacgcccctgcctttctgagactgtctggatgctatatgtacttccatggggactcaggtatgcctccctgcacagacattcatgcgtctgcacatcccacctggacccaagaagaaaaatggaagtaggaacagagaggagctgcaacaaatctccacacgcacactggctaccggcaacactgactgggctctcggctttccagaagatgaggcaagggggaaaagggaccatttgcttaggggtggcacctggggccacgtgctcacacagctctttcttcccaggtatacaggaatgtgctcatgcacataggtcgcaccgggggtttcttgagatgcagcagagaacccgttgtacgggtctgtgggacccccagcagggaaataaaggaaaatcttgagttccttcaagggaaattccaagctagcaccaagttagccctgagaagtaaataagtgacttgataagcaagaaggtaatagtagcttaaaacaatagccaaggaagctagaattacgagatgtttggtttccctatagaaactaaagataacatcttaacatatgtctctgagttgtttttcagaaacccggccccctacggaatgaatcagctggcacagagacctcagatgagggggaactgaggactcaactctgactgctgcttttggttctaaatttcttcctgggccgggtacagtgactcacacttgtaatcccagcactttgggaggccgaggcaggtggatcacttgagatcaggagttcgaggccagcctggccaacatggtgaaaccccgtctttactaaaaatacaaaaaagattagccaggcatggtggcacgtgcctgtaatcccagctactcaggaagctgaggcaggagaattgcttgaacctgtgaggcacaggttgcagtgagccaagatcacaccactgcactccagcctgggtgacagaatgagactcttatctctaaataaataaataaatttcttcctgagggtcctggagggagtcctgcccacaagccagagctaacattttttttgccgaccccaacattttaaacaaagcttcttttccttaagtgattgcaaatcagaagatctttaaatccatccacgacctgtaacccctggcttgaagatagccgcccttttcggtcaaaaccactgtgcaaccgccatgtgtcgattttacaatcttacctgtaacttctttcctgaaatgtacctccgactttaaaaacccttacctgcaagctactggtcaggatttgagcatgagccgccgggtcctccttgcttggtgcccagcaattaaacaccctcctttcttccactgcaacacctcggtgtggatatctggtcttaccacgctgggcaagcagaccccggtttgctctgtaacattttttttttttttttttgagatggagtcttgctcttttacccaggcttggagtgcagtggtgcaatctctgctcactgcaacatccacctcccaggttcaagcaattcttctgcctcagcctcctgagtagttgggattacaggtgcgtaccactatgcccagctaatttttgtatttttagtagagatggggtttcaccatgttggccaggctgatcttgaactcctgacctcaggtcatccacccgtcttggcctcccaaattgctggaattcaggcatgagtgcctgcatccgaccatgctctgtaaaattctgatgggctgcatcttgcagcacacaactcagtaaatacaaagttggggctgggagaccaatgcaaggcggttccatccccagtgcttctgacctgacctgactcacggcacagtacttagaatttctggaagccaaatgtcattgtgcctttgcagccatcctccccaactacgacttctgtccatgagcacttgacaagtatctgtaggcagaatactacagccggccttccggacaatgcccaaaagacagctgggtccggaattggtgggttcttggtctcaccaacttcaagaatgaagctgcggacccgcgccgtgagtgttacaattctcaattcttaaaggcggcgtgtccggagtttgctactgctgatgttcggatatgtttggagtttcttacttctggtgggttcatggtctcgctggctcaggagtgaagctgcagagcttcacggtgagtgttacagctcttaaggcggcgcgtctggagttgttccttcctcccagtgggtttgtggtctcgctggcttcaggagtgaagccgcagaccttcgtggtgagtgttacagctcataaaggcagtgggggcccagagtgagcagcagcagaatttgttgcaaagagcaaaagaacaaagcctgcacagcgtgcatggggacccaagcagattaccccagctggcgcgggcagcctgcttttattctctaatctggccccacctacatcctgctgaatggtccattttacagagagctgattggtctgttttacagagagctgattggtccgttttgacagggtgctgattggtgcgtttacaatccctgagctagacacaaaagttctccacgtccccactagattagctagatacagagtgtccacacaaaggttctccaagtccccaccagcgtagctagatacagagtgtcgattgatgcattcacaaaccctgcaaaccctgagctagacacagggtgctgattggtgtgcttacaaaccttgagctagatacagagtgccgattggtgtatttacaatcccttagctagacataaagtttctccaagtccccaccagactcaggagcccagctggcttcacctagtggatcccatctggggccacaggtggagctgcctgccagtcccatgccatgcgcccacactcctcagcccttgggtggtccatgggactgggtgccatggagcagggggcggtgattgtccaggaggctcaggccgtgcaggagcccatggtggtggggaggctcaggcatggtgggctgcaggtcccgagccctgccccgcagggaggcagctaaggcctggtgagaagttgagcacagcagctgctggcccaggtgctaagcccctcactgcccggggcttgcgggccggccgctcccagtgcggggccgctaaacccacgcccacccagaactcacgctggtccgcaagcaccgtgcgcagccccagttcccgcccgtgcctctccctccacacctccctgcaagctgagggagccagctcccgccttggccagcccaggaaggggctcccacagtgcagcagagggctgaagggctcctcaagtgctgccaaagtgggagcccaggcagaggaggcgccgagagcgagcaagggctgtgagggttgccagcacgctgtcacctctcacagctatccctgagcctgaagggacccagcagcttaaactgcgagtggggaggaagtgagtggtggacctcctttcatccttgctgaacaaggaagctcactgcaatagcatctcttttcccacagggaagcacacagcacggttccccagccaaggcccagcagccctcggggatggctcagttctcctcccctgctcccccaacaggtgcacatccattcacataggggataacaggaggtggcaaaaggtttctaagggccccgtgtctgccgtggagggtgggagaaggggacaggacagtgatgattgctagaagaaagtgatgctgtgaggacctggccaccatcaaggatcctgagaactgagtctcaccccagcccacacacatgctcctggcgaagacacctgctgtcctcctgcccctacacagggtaagtcactctccttacctgctgagaggcagccgtgtgacaggcctgggcaagggacagaggctggcggtggcagcagctgtcagtcgtcagatgagaggtgaattcagagcttctgctttgaggtcacctgaaagcacaaccagagacatgtctagaggtgtggggactccctggcattgctcccagagtccccatccaccctgtcccatggttcccctctcctcaaactcagcagccttccccaaaagcctggggactccatatcagaccttggggagatggggagctcgaggcagacagagaaccctcagatctgacccagagcagactggaaacacaacttcagggccacaggccaccccgggcctcaccagactgctcccctggaccctgcaaaccttcatgcccagtcgctctgccccccaacacaaggagccccagctccagccaaacctatgccaaatggaaacaggtcacgtgttttcttcttataaaaatatacacttggggccgggcgcggtggctcatgcctgtaatcccagcactttgggaggccgaggcgggcggatcacgaggtcaggagatcgagaccatcttggctaactgggtgaaaccccgtctccactaaaaatacaaaaaattagccaggcgtgatggtgggcgcctgtagtcccagctacctgggaggctgaggcaggagaatagtgtgaacccgggaggcggagcttgcggtgagccaagatcgctccactgcactccagcctgggtgacagagcgagactctgtctcaaaaacaaaaacaaaacaaaaacaaacaaacaaaatacacacacacacacacacacacacacacacacacacacacacacctggccgggcgcaggggcttatgcctgtaatcccagcattttgggaggccgaggtgggcagatcaactgaggtgggaagttcgagaccagcctgacaaatatggagaaaccctgtctctacaaaaaatacaaaattagccaggcgtggtggcacatgcctgtaatcctagctagttgggaagctgaggtgggagaatcatttgaacccgacaggcagaggttgcggtgagccaagatcatgcctgggcaacaagagcaaaaaacaaaacaaaacaaaaaaacacctattatcaaaaaatgtgcagataaagataattacaacaaagaaaataaagaccagtgataatgccttttcccagagataactatggttagcctgttgatgtataatatacttacatgcattagaaatttgatttcaaccaaaggacatttagcatagaagagatcagacgactcgaaagctctttttttttaatatttattttttgagatagggtctcgcttcgttgcccaggctggagtgcagtggaaaaatcacggctcactgtaggcttgaactgggctcaaacgagcctgccacctgagcctcctgtgtagctgggactacaggcgtccactaccatgcctggctaatttttactttttttttttttattttgtagagacggagtttcactatgttgcccaggctggtcttgaactcctaggctcaagggatcctcccacctacggcctcccaaagtgctgggattacagccatgagccactgtgcctggcctttgaaaggtttcttacagcccattcaagactcatagccctgttcgccttccctttgcagccatcctccgtaactgtgacttctccaggacagtctctccaggatggctgactctggggtaatgagttcattccccaagggttttccgaatgctctgccctacggcatccatctccgaggcatcctaatgaacttggagcaaagctaaaagcccgacaagaataagctgacagacctgtttgctcccctggctaaaatggaatccaaattcattttggcctcaacttcaggggagatggtttgaagttgtgcttggtgcatttttctcagcctgtgctatggtcagaatgtttatgtcccccctaccccccccaaattcctatattgaaatccaaagccccaaggtgatgctgttaggaggtgggacctctgagaggtggttaagtcatgaggatggagctcttatgaatgggactcatgatcttgtaaagagctctgacagagatccaggaatgctttatgttttagtttgtttttttttttaacttgtttgctgtgtgtgtgtgtgtgtgtgtgtgtgtgtgtgtgtgtgtgtatttttttttttttcagatggagtctcactctgtagcccaggctggagtgcaatggtgcgatctcagctcactgcaaactctacctcccagattcaagtgattctcctgcctcagcctcccaagtaggtgggattacaggtgcccaccaccacacctggctaattttttttctatttttgtagagacagggtttcaccatgttggccaggctaatcttgaactcctgacctcaggtgatccactcacctcccaaagtgctgggattacaggggtgaaccactgcacccggagttggttttgtattttaatataacagtgcttcttctacttttccaccacattctggggaaaacagaaccactgaggcaactggcttccctgactctggctacccaagaccccacccagagggctgaggtgctggatcaaggctgtacctgtaggttgcacactacactccccagcccactgtggggaagctgttctctaccatcggttccccaaatttggttgggatcagaatcctctgggaatgtacagagactaaggccctgctctacccacctccatgaccttagagttctgtcttagctctcttggagattatgataaaaccactgctctataggcaaccagagcttctcagactttgctgtacatctgaaccactagggggacttttaaggatcccgattccagctgggtgcagtgactcacgtctgtaatcccagtgctttgggaatctgcagcggaggattgtttgagcccaggagttcaagaccagcctgggcagcacagtaagaccccatctctacaaaaaatttaaaaattatctgggtgtggtggcacacgcctgtgatcccagctattcaggaggctgaggcaggaggatcgcctgagcctggaattttgaggctgcagtgagctgtaatcatgctactgcactccagcctgggcaacagagaccctttctcaaaaaaccccaaaaatataaaattaaaaaaataaagatcttgatgcccaagtcaaaccccaggccctttaagccacaatctctgggggaggactgaggcatcagtggaagttgaagcttcccaggtgatttttttttttttgagacaggctcactctgttgcccaggctggagtgcagtggtgtgatctcggctcactgcaacctccgactcctaggttcaagtgactctcctgcctcagcctcccaagtacctgggattacaggtgcatgccaccatgcctagcttaatttttgtatttttagtagagatggggtttcaccatgttggtcaggctggtcttgaacccctgacctcaagtgatccgcctgccttggcctcccaaagtgctgggattacaggcatgagccaccacacccggccttcccaggtgcttttaatgtgcagccgcgtttgagacacactgctcaagtctgcatctagctggagcatcccacactttggtgtgtatgtcatgaaacccgtatctcaggctctcactcaacaggactggctgggacctcggggaggctgcatgctgctactcacagcctggtgggagacatcagcttcagtatcccctggagctcgttagcaatgcagaatctcaggtcctacccaaacctacgaagtcaaatctgcgggtttttttgttgtcgttgtttgttttttggtttgttttttttttttttgagacagagtctcgctttgttgcctaggctggagtgcagtgacgcgatcttggttcactgcaaccgccgcctcccgggttcaagcgagtctcctgcctcagcctcccgagtagctgggattacaggcgcgagccaacacgcctggctaatttttgcatttttagtagagacggggtttcaccatgttggccaggctgataacaaactctgacctcaagtgatccgcccaccttggcctcccaaagtgctggggttacatgtgtgaggcattgcacccagccgaatctgcgttttaacccaggtgattcaggtttacgttagagtttgaaaagttctgagctagaccagcagggcccagtcctgccttatgcagggtccaagatgaagagcctggctgaagacacgtgggtcagtcataacagtggtggacagcagaggtgctgttctcctgacccttaatgttattcacagccccatcagctttttagattcctcttttagataacttactaactctagaagctctttgagaggccacacatcagaaaagacactatcaatttctccttgtcctcctggcatttgcatagcatcttccatccaacgcttgaaatgtatttcagatgtcaacccaccagcctaccccaggaagtgattttagacaccttccctgtatcattgctatttctcaaaataacacagattgttggagctgatgggaatttagctcttgactggattcctttatctggttgcggaagaaagctttttttttttttttttttttttttttttagacaggcagagtctcactctgtcgcccaggctggagtacagtggcacgatcttggcacaccacaacctccacctcctgggttcaagaaattgtcctgcctcagtcactcgagtagctgggattacaggcatgtgccaccatgcccagctaatttttatatttttagtagatatggagtttcaacatattggccaggctggtcttgaacccctgacctcaagtgatctgcccaccttggcctcccaaagcgttgggattacaggcgtgagccatggcgcctggcttttgtgtgtgtgtgtgtgtgtgtgtatatgtgtgtgtgtgtaagagagagggtcttgctctgtcacccaggccggagtgcagtggtgcaatcatagctcactgcagccttaatctcctgggctcaagtgatcctccaacctcagcgtctggagtagttaggactacacccagctaatttttaaactttttgtacagacaggatctcactgtattgcccaggccggttttgaactcctggctcaaaggatcctcccaccttggcatcccaaagcattgggattacaggcatgagccaccactcctggctgaaagctgctttttaatagcactaaattttaccatgatgttttcaaaagcttttcttccctctcaaaagaagaaaatatattcatctttgaaaaaattgctgtgtttcattgtgaggtagtgggaaggcccactggctggccatgagctaactgggagcccctcaagggcagaggccttgttttttttagcttctgtgcccccattgccaagatagggcgggcacgccgtagccagtccctatgaacgtgactctggtgtgcatgaaagaataaactgaggcttcaacagagactttaattccccatggctgctgctgtttcagttcttaaatggagctaaattaactctgggttgtgaagggtaatgacccagagtcatgcagatgtactgatggctccaacaacttccttactttgagaaacagtgatgatacagggaaggtgtctaaaaccccttgttagggtatgggataggctggtgggctgacatctgaaatacattccaagcaatggatgaaagatgtggctactagaattaattaaatcatctaaaagaggagccccctagtggtgctcggctttgaggcacaggtgtgaggtctctgctctcacagagcttactgcctggtgaggggcgccatggactgctggaatcaccatgctgatccatgaatattcttatgagggaggcgcccggctctcagtgtataaccaaagaacttgacctggactttagcatctacattgctttctatgatagattctgaagccgtaagatggaatgagacttgcccgccctcaaagagctcaggtgctgagggagagatgtataaataagcaatgatcatattgtcatgggtgtatgtgggctggctgtccacagaacccatgctccccttcctctcacaggaatgtcatggtgacagggcaggtggcccctggatagatattccccagggtcgcttgcagctacgtgtggctttgtgactcacgtcttgccaatggagatgccgacgatgaatgagtggaaatgatgggtgccgcttccaggcctgggctttcagatatcatttggggacctctgagctctttcccatcacacgtggatgtgtctacagcttaagttcaacaagggcaggcgaggacagtggcctgagtggtgcctccaggtgtggtccctggaccggaggcatcaatgtcccctgggaacgtgtcagaaatgcaaatgcttgggcccactcagacctaccaaaatagaagctctggggccaggcacagtggctcacgcctgtaatcccagcactttgggaggccgaggcgggtggatcacctgaggtcagaagtttgagaccagcctggccaacatagtgaaaccccgtctctactaaaaatacaaaaattagccaggcatggtggcaggtgcctataattccagctactgaagaggctgaggcaggagaatcacttgaacccaggaggcggaggttgcagtgagctgagatcgcgccattgcactccagcctggtccacagagcgagacccgatctcaacaacaacaacaaaaaagaagctctgggcgtgggaaagtgcttaacaaggcctccaggtggttctgatgctcaagacaatctgagaagcacagtcctgggggacgagagagaaacaaaacggaaagagcccacgtccccaaattccccctggagctgagcggccccgttagcctggcttcttacttctgggctcatatgagaaagtgaaatacatttccacactctttaagtcaccgtgtttctgcgtctcttggtcacagcagctttgcatctcactaaccgatacagtatttcaacagaggttagtatactggatggctgccttgaaaatgcttttaaacctgagacagaagtactcatttaagagcttgtatttgggaaactcaatacaatgaggcactcaggtctaacaaggattccacctagtgaaactgtgtttatttctagggtctaacattttaccctaaaattctgttagatgctaggcccaccagatagcactgcttttgcaccaacattcaggctgggttctcctagcgttcatcgtgagcattaagattcccccctttcagctgtaagaaaaattggctttgaattgtcacaagaatttcactaactgagttgacatcttggcattccctcaagaatagaggtcacgttcgcttccacacagggatctaaaagggaggggagggccgggtgcggttgctcacacctgtaatcccagcactttgggaggtgggcaaatcagttgaagtcaggagttccagatcagcctggccaacatagtgaaaccctgtctttactaaaaatacaaaaattagccaggtgtggtggcaggtgcctgaagtcccagctacttgggaggctaaggcaggagaatcgcatgagtctgggaggtggaggttgcagtgagcagagatcgcgccacttgcactccagcctggacaacagagcaagactctatctcaataatgataataataattaataataataataataataataataataaaaggcaggggaagtcctaattcacctggatgtcataatcgctgtggcagcaaagggcacagcctttctatctgtacacgtggatgtgtaaggtggcattttagcaccacatgatcaattctgctgtttctcagtcatcctaggctggagctgaatgtcctgacccctgaagggagtgcagggaacgaggtgccctcccacccagacacccagggctctacgtttgcagtaggaacaccgtccccctcgcagggggatgactcttccccactccgacttcaaccactttgcaaattaagtactgtgataggcaagcttgatacattttacagtatgggtctcaattactcaacttacatcttgagtgcccgatagcatccagctggtctaataacacctaatcacacagatgctaaacaagtccagggattcgaagctttgggcagggcatgggttgtaatggacttgagagacaaccacagtttcttaggaagagcacgcggggtccgaacgacgctggggcctgctggtcacctgtcaccttatctggtccttattaaggtcaagaaaattagagaaggttggcagaccagcggttatacttaagaacatttgacaaattagtgcagaataaacaacagaaagagaaactagatccaccttccgtgggacccttcacgctatccactccctcacctagctggccacccagacactccctgaccattgcttcggccttgcaggtagaaatcaaaactcttaatcaacaggagaagatgttagaagtttactcgtggcctgaggctcttacatcagcccttactgactgtgatgttaattctttctgactgctgggttattcaagttactcaaactggaccacggtgttgaccggcacgtatggaggaacacaaacctgtgtctggtgtgtttgtacagtctataaaccttacagtctagaatgaattcattgtcattcgagtctatcgcagctctactgaagtgggcagatcaccacacgggggacgaaaaggtagttgagcgatggcgtggctgggccacgtctcagcttcctagagctgtgggaacaaattactacaaaccgtgtggttctaagcaacaaaaatttattctctcacagctccggaggctggaagtccaaaatcaaggtgttggcagggtcacgctccctctgaaggccccaggagaaaatccttcttcctcatcttttcctatcatctggtgacctctgataacacttgacattcaatccttgatttgtagacatcactccaatctctgcccccatcttcacataacccacttctctgtgtctcaccgtgtcatcttcgctccttataaagataccagccattggtcttaggtcccactttaatccagtatgacctcaacttaatcatatttgcaaagacccactttccaaataaagtcatattctgaagttctggatatatatgaattctgggggtaaactctgaactcagtatagtcaggaacccagaaatgtggccacaagtctgtgctcactactacaaagaatcagattttgttgttgttgttctttgtaatacctacaagaaacgcctctctgacaattgtatggcgtttcatggctgtgggagaggaatgtatctcagggtgatgggagcatgaactgagaagcagaatttataacctatactcacctcaatttttttcacttgtaaaatgagaaaattgagatccggccagctaagtcatttgtccaaagccattaaatagctaataagcagcaaaaataaggtgagaaccccatatcattcattcattcattaaacacatactatgtcaggcatctcactgaagaaatgaggaagtgggtggaggtggaatatgattcctgccttttttttttttttaaatggagtctcactgtgttgcccaggctggagtgcagcggcacgatcccggctcactacaacctccgcctcccaggttcaagcgattctcttgccttagcctcccaagtagctaggattacaggcatgcgccaccacgcccagctaatatttgtatttttagtcgagatggctaggctggtctcgaactctggacctcaggtggtccgcccgccttggcctcccaaagtgctgagattacaggtgtgagccaccgtgcctggcccgtgattcctgccttctatttatgtggagacaaaactaacagcagcaaactcaacaatcaaatcaaggtgctaccacagaggtcagtaaagggtagaggggccaagaaggagatgatcgattcaggtaaggagaaggttaggaagggctttatactcaatttgagcctaggaagatgaatgggacccactaggcactgtgatcagagagggggagttccaggcagaagtcccatgcaagtgtggtgttgcagcatgggtaaagacggagcaactgagaaccagcctggcactttcaggaaaccctgggtggtcccttattcctgaagcccaggaggtcagggagcagaccaggaagggccttgagtgccacactaagagtgtgggactggtatcatgtaggcaggtgtcatcaaatgaagggttatttaacagagaagtaaaaagattgctgttacattttatttttttgattgagagtgtgggggggtgggtctcactgtgttgcccaggctggtcttgcactcttgggcttaagtgatcctctggcctcagcctcccaagtagctgggattataggcgtaccaccatgctctgctgttacattctagaaaggtcacttcaacctagtgtggagaatggatcagaggtgaacaagataaacaagcagaccgaggtgggcggatcatgaagtcaggagttcgagaccagcctggcctgaacatagtgaaaccccatctctattaaaaaatacaaaaaattagccaggcatggtggcatgcacctgtaaccccagctactcgggaggctgaggaaggagaatcgcttgaacccaggaggcagaggttgcagtgagctgagatcgtgccactgaacttcagcctgggcgacagagcaagactccgtcttaaaaaaaagaaaaatcaaacagaccaatgaggaaaccatgggagtctagatactggctctggtagggagacggggtggagagccaggtggtgagggtggaagagccaggggatgtggttaggatctggatgctggggaggggggaaaggaaggcatatctgggctgaccaccagggagatggtgctgtgctgttccgcacgcttaggaaaagagcaagtggaatggggtgcagagttcacatagggccaggctgaacttaggaggcctttgggaaactgagaagcacatggccagcagacaggaggactgatagagatggaattcacagggagtttgggctgaagacggagctgagcaactcatgacttgtaggggcaggggaagtcctggctgtgggaggctcatgggccagggggagcatgggtcagaaggctgggctgcgtgcagagcctttggcccaaagcagcatgggggggcgagcagaggaaggaagccgcatgctcacttctccagtagctagcttccttccttccttccctccctccctccttcctttctttccttttttttttttttttttttgagacagagtctcacccaggctggagtgcagtcgtgtgatctcagctcactgcaacctccgccttctgggttgaagcaattctcctgcctcagcctcatgagtagctgggattacaggtgcgcaccaccacacccagctaatttttttttatttttatttttagtagaaatggggtttcactatgttggccaggctggtcttgaactcctgacctcaaatgatccccccgccttggcctcccacagtgctgggatgacaggtatgaaccatcgcacccagccctgaaggtttctttctatgttcttcaatctgtacttttcagatttgtggaggtaaaagattacttagtgccaataaaactaattattctttccagaccaaatattgaaatggtgctaaatggagaagtgacagatgagctatggtgtcaccaccaacatcagattacacagcacggatggacagtgtgttgttcaatgaggttgctggccatcgccactgggtgcaccgtggggcctactctcgggaggcagccgcctacagcggaaagcatgcagacaagtggttctgtgaattatctgaagcaaatgcattgtacttcacagactctgtagtagaaaaccaccagtgtgaatttagtgggtcacgcgctttgatcagggagaatgagttcgcagcagttcatccatccacgccgcccagcctgactccctttcatgccatcccatcggcacggcttttcagtattcttgctagggttagggtgcagcctcctacttcagagcaaagccacaagagcagaagtcatgaggccaccctccctgcctctctccgggagggtgtctcctgcccagcacagggcccagccccctcccctcactttagtccattctgatgtgggactttgaggctgtccaagaaagatgaggtgactccatcctctgggaccagctacaggaaatgctgtttctattttttttttttttttttgagatggaatctcgctctgtcacccaggctggagtgcggtggcgtgatcttggctcactgcaacctctgcctcccaggctcaggccattctccttcctgagcctcctgagttgctgggactacaggcgcacgccaccatgcccagctaatttttgtatttttagtaaagacacggtttgaccttgttggccaggatggtctcgaactcctgacctcatgatccacccacctcggcctcccaaagtgctgggattacaggtgtgagccactgcacctggccaggaaatgctgtttctaaaggctgctgccagctgctgccaactatgttttatcacttaccatttcctttttaaaaaaataccaaattcacattgaaatgcttgaattaaaaaagtattgaggttcaattcacttacaataaaattaatcattttaaaatgagcaactcagtgacgtttagtacatccacaatgttgtgcaaccaccaacactatttagttccaaagcacgtccacaccttcagaataaaacctcattccattaagcagttctccattaagcagttctcttcacttcccgctcctcccagatcctggcaaccaacagtctgctttctgtctctacagatttacccattctggacatttcacataaataaaatcacaaaatatgcagtcttttgtgactggattcttcctttgttttcttttttacttagttttttattttttattttttttttttttgagacggagtctcactctgtcacccaggctgaagtgcagtggtgcaatctcggctcactgcaacctccgcctcccgagttgaagtaatcctcctgcctcagcctcctgagtagctgggattacaggtgcccaccatcacgcccagctaatttttgtgtttttagtagagacggggttttgccatgttggccaggctgatctggagctcctgagctgaggtgatccacccgcctcggcctcctaaagtgctgggattacaggtatgagccactgtgtctggctcctcaatttttttttgttgttgttgttaaatagagacaggggtctcacattgctgtctaggcttgtctcaaacacctggctccaagcgatcttcttaccttggcctcccaaagtgctgggattgtaggcatgagccaccgcacctggccagcttttttcacttagtgtaatgttttcaggattcatgcatgttgtagcatgtatcagtatttcattcccttttatggctgaagagtattccatgatgcaggtgcaccacatttagtttatcggcccatctgctgatagacatttgggctgtttccatcttttggctattgtgaataatgctgccacgaacatgtatttgagtacctattttgaaccattttacattctcatcagcaatagctccaatttcttcacatccttgccaacatatgttattttccactttttgggttatagccatcctcgtgggtgtgaagtggtaccctctcttggttgtgattcgcatttgcctaatgactaatgatgtggagcatcttttcatatgcttgttggcatcatttactttaaaaaaaaagtcttaacattaaatattttgaattttgtaacaattcaagttttcagaaaggttgcaagtatagcataaagaaaagtttcctggccgggcgcagtggctcacacctgtaatcctagcactttgagaggccaaggcaggcagatcacttgagctcaggagttcgagactagcctggacaacatggtgaaaccccatctctacaaaaaaaattagccgggtgtggtggcacacacttgtagtcccagctactcgggaggctgaggctacagtgagctgagatcacgtcattgcacaccagcctgaatgacagagcgagaccctgtctcaaaaaaagaaaagaaaaaaaaagtttcttgaaccacttgaatgggagatgtcaacctaactgcctgtcagccctgaatacttcttatttcctacacagaaagacatgatagagccatcaaagttaggaaactattattgatacgttaccatcatctaatcctctaacgctattcagatttcatcaaatgcaccagtaatgccctgcacggtagtaaattcagctgagaatcacacgccacatggagttcttatgcctctttaacccctcagcccttccttgactttgacgacccacagcactttccaagatagcggccgttattttgtagaacacccctcaattcgggcttcttttctgtctcctcataagatgcaggtgttatcctttgccaggaacatcacagaagacaaactgcattcttctcattgcatcctatccagtagcccaagatgtcaccttgtcccattaatgatgttcgttgtcatcacgtgattaaggtggtgtctgccaagtttcttcactgtagttactttttatttttgtaatgaataagaatttgtggaaagataccttgaaactgtctaaacttgttccttatcaaactttcaatatattcaattattggctgctattaggaggcactcagggttttctgttttattcagtaggctacaattcattactatcagtatttattttgatgtataaattgtcctggatttggccagtgggagccccttcaagctggttcctgtgtctttctcgaatgtctttatcatttttgattaatttctgactttcctaccattgcctattcaaggtgctagaaaaaggctcctgtttcaaattcctaccaaactgctgatttcctctttctctcaccctggccatgtgtctctgtcaagataaaaaaaagcactgcaagaggctgggcgtggtggctcactcctgtaatcccaacactttgggaggctgaggagggcggatcacctgaggtcaggagttcaagaccagcctggctaacatggtgaaaccccatctctactgaaaaaaatacaaaaatttgccaggcgtggtggcccatgcctgtagtcccagctacgcaggaggctgaggcaggagaatcacttcaacccaggaggcggagtttgcagtgagctgaaatagtgccactgcaatccagcctgggcggcagagcgagacttcatctcaaagaaaaaataaaaaataaaaagaagcactgcaaaagagataaaatgtagttacccacagggcagagattctctctctctctcttttttttttttttgaaacagggtttcactccgtcacccaggctggagtgaagtggtaccatcatggctcactgcagcctcaacttcctgggcttaagtgatcctcccacctcagccacctgagtagctgagactacaggtgtgtgccaccatgctggactaatttttattattttttactttttgtaggacagggtcttgccatgttgccctggatggtctggaactcctgggctcaagcagtcctcccactttgcctaccaatgtgctgggattatacatgtgggccattgcgtcctccctggaccgagattcttgaatatgtagtgcccagcaccagcaggaagtcagtgagtagatttgaccattggttggatgtatatctgtgacttagggtccataaagatcttttgaagaactgggcactaatcccaacttcgcattagacaatgttgccaagcaggtgggttgttttttagcatatttgagaagggggaaagagcccactaactttctgggcaaatttgggcaaattaccaaccattgtgggtctcagtttcgactgttaacagggttgcctgagcattgccagtatatatgatgaagtattggccaggtgtggtggctcttgcctgtaatcccagtctttgggaggtcgaggcgggaggatcgcttgagtccaggagttcaagaacagccgaggcaacatagtacgacctcatctctacaaaaaataaataaaattggccaggtatggtggcacatgcttgtagtcccagatactcaggaggctgaggcatgagaattgcttgagcctgggaggttgaggttacaatgagctgagattgtgccactgcactccagcctgggcgacagagtgagactttgtctcacaaaaaaaaaaaaaaaaaaaaaaaaaagaggagaaagaaaaagaaaacgaagtacttacaaatataagggttggctcctcattggttatcagatggaagacagcccctctttagcccaggacaacgtcgaagattgactagacattcagactcacaagacgatgacagaacgtgctccgatctattcagaaggatggggacagaggccctggcctgccagcagaacaatgccaggctgccttgtgtgaggagtcctggagaatttctcacagcagagtatgtaacatccaggagttatcttagccccatgtgatggtcatggtgcaaacagacggggccttcacagggaggtgcagggtctgcgtgggaagatgcgcaccacagggcagtatctcggggacgtgactttcacaagcgtcactgtcttggttcacctgggctgctataacaaaataccataaattgggtaggttttttggagacggggtctcactgtcacccaggctggagtgcagtggtacgatcatgactcattgcagccttgacatcccaggctcaagtgatcctcctgccccagcctcccaagtatctggaactacaggtgcacgccactacgcctggctaagttttgtatttttagtaaagatggggtttcgctatgttacccaggctggtcttgaacacctgggctcaagtgatccacccgccttggcctcccaaagtgctgggatcacaggcatgagccatcatgcccgtcctgggtagcttttaaactacaaaatttattctcacagttccctgagcttagaaattcaggctcagggtgccagcatggtcaggttgtgacaagggcccttttctgggcggcagactgttcacctctcactgtgtcctcacatgagggaaggggcaaacaggctcctcaggcttcttttataagggcacaagtccaattcatgagggctctgcccccatgatctaatcacctcctaaagccccagtactactgcactggggattagatttcaacacagaattttttttggaggggtgggggggtcacaaacattcagaccatagcagtcaccaaaatgctgagaagttcaaagcatggcgtctacatcagatatttaaattccattcctagctactcccagtccatatgtaattcaccagtcaggggccatttttaccataagcaatgttgcctggcaatgtagttgacatatagcatcttaactggtttacagggtgaggcaggcagaataatggcttcccaaagttatctgtgtcctactccccagaacctgtgaacatgataatgggggttttaggttgcagatgcaattaactaaggttgctaactagctgaccttaagacaggcaggttatcatggattatcctagtggaccctatgcaatcacaaggggccttgtaagtgaaagagtgaggcaggagagtcggtgtcagtcagagagagagatgaagatgctacactgctggctttgaaggtggaagggggccacaagtgaagggaagtgtccagcctctagaagctggaaaaggcaagaaggattttctcctggtgtttcctgaagaaacacagctctgccaacagcttggttttaccctactgagattcattttggacttctgacctctagaactgtaatataataaactggtgttaagtcactaagcatgtggtaacttgctacggcagcaatacagggtaacagagctaggtagttgccaaggttgggttctcatgcagcagaggaagagggtgtgtgaacctttcaagcagtcctgacatataaggctggcaatcttcacctcctgggttcaagtgatcctcccacctcagcctcctgagtagctgggaccacaggtgtgagtcaccacgactggctaatttttgtatttattgtagagacgggcttcatcatattacccaggctggtgtcaaaatcctgagctcaagtgatctgcctgcctcagccttccaaagtgttggaattacaggcgtgagccgctgcgcctggcctagattctccatttcttctgtgtgatctttggttgtttgtgttttccatagaatttatccatttcatttcagctgctgaatttatggccataacattctttgtaatatcctttttatgtatgtaggtctgtagtgatgttccgtctttcatttctgatattggtcatttgtattttttttttcttggatggtctggctagagatttatttttatgactcttttcacaaaagcagcttttggtttcattgactcttttttctgtcctcaattttactgatttctgctttattattctatattatttcctttctctgcttcttttgaatttctctctctctctctttagtttattaaagcaaaagctgaggtcagtgattagagagaccttcctttttttctaaaataaacatttttgcctgacacagggatcagggttcaggcagatgggtgcctgtgcagacgtatggactgagctgctcctgccgtagccagcaaccctggggccctgcagctgaggctgcatgggggtggctgctgtctgcttgagtgtcaggcttatttggtgaccatgaagctgctgtacctggccttccacagctgcctcctactggccctgctcagcgcatggtgaactgctcctgaggatcatgcgtcacccacaggcgtgcacgctgtcagtgctacctctttcctgtgggataaactcagcagctgaatctggatgtggcagtgggctgggagcagcctcatcctgctcaactacctggaattgggagtgaggtgggataaggtcactgagcccatgcagggacagaggaacctctcgatgtgctttagttctggagactgctttgctgcccacaatttcagtggcagtcatggattggaaggagtgagctccaggagctctgccgccattctccaggagctagattcctggcccgcacctctgtggaccaggagaacgagagaatgcatagatcgaagaggggaggctgagcacaattgaagtgtggggatatagtctcctctgtgtgaccattatcatggattatcctggtggaaccaattaccatggattatcacaagggaccttgtaagtgaaagggcgagcagaagagtcagtgtcagagtcagagagagatctgaggacgctacactgctggctttgaaggtggaagggggccacaagcgaaggggagtgtgcagcctctagaagctggataaggcaagaaaaaggattctctgtcatgctgttcaatgctgggatgaccatctagtgcaactgaagtgtggggatacgatctcctctatgtgactgtcatctccctctgctccctcatgggcaccatcgtggtgccttcaagaaggccttttacagaaggaagctgctgctccacgtcatagctctggcgattggaatcctctagtccaatgtgctctcctagctcattcctggggcttttgatttcaaccctctggaagatgattatgtgtccaagtctgcagtggtgtctgggggcttttatttttatttttcagagatcttgaagatgtttctcaaacaggaaaatgaacatcacatagacatagccattatgcctctgagaggcttccttccaagaagcaccaggaggaggggggtgatggagaagctgcagaatggggacctggaccacatgagccctcagcactgccacagtgaactggatggcaagcagtccatgatggatgggaaggtcgtggtgggctcactctctgtgctggttctgcaggctccccagagtgcctgctggagctgaaaggtgtccactactttatcagcactctggcctgggtgatcaccctaagcaacagcctccacaatgtcctcagcagcctggccactggcgcctctttcaccgtctgtgtggtccaaggcctcggcacctggtggccgtcttccatgaggagttcccacatgactttgtcatcctgcttagcgctaggaggaccattcagcactgtcttcttcaacccccttccgcctgctgctatgtgggtctggcctttggcatcctggccagcagccacttctctgccaactgaatttttgtgctggttggaggaatgttcttgaatattgctgtggttgatatgttccctgagacgaatgaggtctgccaagaggatgggaggaagggcagcatctccatcccctttgtcattcagaacctgggtctgttggccagattcaccgtcatgctggtcctcgtgatatattcaggacagatccagattgggtagggccctgccaggagcctgtgggatgggaagtcaggccctgggctgcccgatccctggcctgaggactcgccatccacaaagcaccgtggaagaggttgttccatgaaaaacttacacagattgtattcccgccttcagatgtcagcggtgtttacaatgctctgtcctaggaagaaacgtccctagtaaccagtctccaggtagtacctctcaccctctcctcacctccttttctctctgtgactctggaacctgaatgcagcttgcaagacaagcctttttctctgattaccctcgcctctttcccttggaaccagtgctgaaagatgtgtgtgtgtgtgtgtgcgcgcgtgttttgagatggagatttgctctgtcacccaggccggagtgcagtggcacgatgtcagctcactgaaacctccaccttccaggttcaagcgattctcctgcctcagcctccccagtagcagggattacaggcacccacaaacacacctggctaatttttttttttttttttttttcagtagagatgggttttcgccatgctggccaggctggtctcgaactcctgacctcaggtgatccatctgtctcagcctcccaaagtgctgccattacaggcgtgagccactgtgccctgcccagtgccgaaagattttgaatcctttacctgacaatgcaaaaatacagccagtggttttaacttggttagaaatatcaagaggtgaatccatagtttggggcccatgacattggctgggcatcctggacctccggctggccagttttgaaacaggttcacctcttcttacagagaagatgcaggaatccctcttattttttcaaagtctgcttagttgcctattacttctctcagagagaattctaagtgagaacagatgacagggtgagaggggaggcagggatcatccggagtgggagagaaagtgggacggatgctctgtgtcttgtcattttgctcatctgctcctagcagaatgctgggtattgatttgggggcagcacctggtatttcctggctgtccaggtgagctaatgtggaggtaatgtagcttcctggacctcctctttcaggtcaacactgacagaatggaaggtcagagagtctacaaggaaacaatgttttgctgtgattcccacttcccttccccactcctatcttctaagagacttgcaggctgggtgcggtggctcacgcctgtaatcccagcactttgggaggctgaggtgggtggatcacctgaggccaggagttcaagaccagcctgaccaacatagtgaaaccccatctctactaaaaatacaaaaactagccaggtgtgttggtgtgcacctgtagttccagctatttgggaggctgaggcatgagaattgcttgaatctgtgaggcggaggttgcagtgagctgagattgtgccaccgcactccaccctgggcgacagagtgagactctgcctctatctaaaaaaaaaaaaaaaaaaagaaagaaaagaaaagacaagacaagacttgggagctgcctccctaaaagcacattctgagcatatttcagacatctctgttagaaggcagactgcacaaactatcctcccctagtggagatatctgcacagtggcaagctgactggtagaattggaatgcagtttatgctctgcttaaacaagggtaatcagaaatggaatcagtgcaagcaaaatttaggatttgctacttccataaataaaagcatgaataacaggggtctctgaaatgtaaggtcacaaacttagtttggggcactgcagatgtttgcagaatggcagcccagtgattatgctacagatgggctttcaatcacctgtgtaggttaccgcttcctccctcacacacacacaaaaagtggaatccttcgttgaactgaatatgaatatgaattgctctgattctgcccagaaaatggacggatatacttgtctgtaaaaccgtgggccagcctcaggcacgctggatcccttgcctcagaactctggcttcaaggaaagctaatctgcagggctcactgtgtgaatcgatttattactatcacatggataacatgagtttctttagccaatttgggaagccagactctccagaagcctttctcagtggtgcctgcagttgcagcccaggggctgtgttcacaaactgattcgtgtgcatgattcacaagagtactgcttcattgccattgcctaaatttttaatctttttgtttttttttttttgagacagagtctcactctgtcaccgaggctggagtgcagtggcgtgatctcggctcactgcaacctctgtctcctgggttcaagcaattctcctgcctcagcctcctgagtagctgggattacaggcatgtgccaccccacctggctaatttttgtatttttagtagagacggggtttcaccatgttggccgggctggtctcgaactcctgagtccaagtgatcctcccaccttggcttcccaaagtgttgggattataggcgtgagccactgcacgccgccagtgagtttttcatcttcttagacagaaaactgtccactcttagtcattaaaggcagcatcagctgggtgtggtgagttcacgcctgtaatcccagcactttgggaggctgaggtgggaggatcacttgggctgaggagttcaagaccaccctcggcaacattgcaaacgctgtctctaaaaaaaaaaaaaaaaaaaaaaaatttatatatatatatatatacacacacatatatatacacacacacatatatatatatacacacacacatatatatatacacaaaaattaattagctgggtgtggtggtgtgggcctgtagtcccaaatacttgcagggctgaggtgggaggatcacttgatcctgggaggtggaggctgcagtgagccaagattgcgccactgcactccggcctgggtgacagagcaagactgtctcagggaaaaaaacaaaaaagcatcagttttgttttcccttcctgggagacatctctcaaaccagggatattcttgaaaagagcatgagcaaggaaactgctggtgatattacaagtttctctccttatcttgcctgttgacttcaatagatttgagaataggctgaagagggaggaaaacttcagtgattgagattctagatgaaatatcaggactgactcctgataggattatggtccaggttaaccaaaaaccaattccttgaatgttgaaatctaactttttatattatctttattattgttataaaaacagttcttcatcttttctgttttatttttctaaaactgctttcaggagctaccagaaaataacactcaaagtttatgactctggaagattttgctttccctaactcacatcgatgtattaaatgtataattttagcattccctatagatcttcttataccttaaaaataatagcctttgttttggagaagaaagtactaagttagagttagcaggtttcttgtttaggagaggagctcaaaaatataacctttaacaaattgaaaaataaaatatgaaataatagggtgctttctcttttgtgcacagctatattaagaaatttcctttcatagacagctacctcaaagggaaatccttttaaaactttcgttggaggttgggcgtggtggctcacgcctgtaatcccagcgctttgggaggctgaggtgggtggatcacctgaggtcgggagttcgagaccagcctgaccaacatggagaaaccctgtctctattaaaaatataaaaaattaggcgggcatgttggtgcacgtctgtaatcccagctacgtgggtggctgaggcagaagaattgcttgaaccggggaggtggaggttgcggtgagccgagatcacaccattgcactccagcctgggcgacaagagtgaaactctatttcaaaaaacaaaacaaaacaacacaaaactctttgggtgcagaggtcagtcctagtcggaacttagtggggctggagacagtcatattatctcctgactgtaagttgccgttggcaacagctttgcctggtgagttggacttctgggtgttgaatgtgcagtttgtttgtttgtttgtttgtttgtttttgagacggagtctcgctctattgcccagactggagtgcagtggcgtgatctcggctcactgcaagctccgcctcccgcgttcatgccattctcctgcctcagcctcccatgtagctgggactacaggtgcccgccaccacgcccagctaagtttttatatttttagtagagacagggtttcaccgtgttagccaggaaggtctagatctcctgacctcgtgatccacctgcctcggcctctcaaagtgctgggattacaggcgtgagccactgcgcccggccaaatgtgctgttttaagcatttgtacatctagaagtctaaggaatagccagttgttctaaagacttttcacccctggcattagtagcttcaacctctttctggatggaccagcccctgttaatgttaccaaggaaagtacatgtcacatgcaggaacagtaagccagcaccaggtgtctgctccttctcacctagtcactggcaggcaggctgcccctgtccttgctcctacaggtattttgtgtctaatgtcaattttgggggctattcctcattggtccgtcaccttgggtttaaaaaaaaggaggctctgtttgggttgcctaagatctggtcttagtaagccctcttctgacgagatggtaatatgctggagattagccaaaaaaaaaaaaaaagtctaatttttttttaatttttcttttttctttcctttttttctttttctttttcttttcttttcttttttttttttgagacagagtcttgctctgtcacccaggctggagtgcagtggctcaatcttggctcactgcagcctctgcctcctgggtttaagcgatcctcccacctcagcctcctgagtagctgggactacaggtgtgcgccaccatgcctggctaattatttttgtatttctagtagagatggggtttcaccattttggccaggctggtctcaaactcctgaactcaagtgatctgcccacctcagtctcccagcatactgggattacaggtgtgagccactgcacctggcaaaaaaaagttgtccgatatttgtgtgagaggattttattgttcatatttccctttacagttctgcaattccactgcagtattttaccctttttttttttggagacagagtcttgctcagtcacccaggctggagtgcagtggcatgatcacggctcactgcagctttgacctcctgggcttaagtgagcctcctgcctcagcctcctgaatagctgggactacaggagtgcaccaccatgtctggctaatttttgtatttttagtagagatggggttttgccatgttgctcaggttggtctcgaactccaaggttcaagccatcctcccacctcggcctcccagagtgctgggattacaggcatgagccaccgcacctggcctccagcacattgttttaaaaaataactcagctcttatgaaaagaaattagaaaataaaattaacttatgtggactgtaaatgatttgtaagattctataaataaagctatattctataaaaatgaaacgaaataaaatcagcatttaatggtatgaatttccctttaatcactgagtcccacacatttttatatcaattcaaaatattttctaatttctcttttgatttcctttttgaaccatgggctatttagaagtgtgttgttagattaggtgaggttagattctgatctcagcttaatttttagtctttgcaactccaagagacgtgagtagtggtatgaatcctaattctgttctcaaagcttttgctatgttactttggttctgtcctaagcatgtgtagctaaggggtgaggctggaacttttgtggttcataaaaagagttagatgaggctgggcgcggtagctcacacctgtaatcccagcattttgggaggctgagttgggcagatcacttgaggccaggagtttgagaccagctgggccaacatggtgaaaccccatctctactaaaaatacaaaaattcggccaggcacggtggctcacctgaggtcaggtggctcacccagcactttgggaggccgaggcgggtggatcacctgaggtcagcagttcgatcacctgaggtcaggagttcgagaccagcctggccaacatggtgaaaccccgtctctactaaaaatacaaaaattagtcaggtgtggtggtggaccccagctactcaggaggctgaggcagaagaatcgcttgaacctgctgggaggtggaggttgcagtgagccgagattgcaccattgcactctagcctggtgacagagtaagactccatctcaaaaaaaaaaaaaaaaaatagccaggcgtgatggtgcatgcttgtaatcccagctactcgggaggctgaggcaggagaatcgcttgaacccgggaagcagaggttgcagtgagctgagatcgcgccactgcactccaccctgggcaacagagcgagcctctgtttcaagaaaaaaataaaaaagaatgagatgatccacttctcacactctctcctctccagggtttctgccacaccctccagttcaaaagggcaccttttcctgtttccctgaccagaaagacagggtttatcttggagatttagcctgcatgcagccaccactgtgcaattctgaactggggcccgttcttggggcaaagctgtgagagaaaggagaaaaagaaaaaaaaggatcacagggttccctttccccagttcctctcgccagccatgtggggtttccatcagaacattcgctacctgcacggccaccgctgcagccctgctcttgggcccactcaggtcaaagccacaagaataaggagaaaacaaatgtaaaggacactcccatccacacaggtgacttcgtggcttctgcctgtcctccccaatccacatgctcttatgtgattcgtgagtcctcagggagttgctttttatatttttccagcgtttttgctgcagtctgcaggagagacgggctgtagcgggcttgctccatcctgggctctccatatgccactccctctgctgagaacgctcttcctttcttgtctggtgagcacctattccactcccataccttgcatcagctgtcctgacctccagggaatctttcctgacctccagaggatctttcctgaccactttcaccttttaaattcagagcggggggtgcctccgccacagcagcccccctcatcatgctgtctccccagcaaccagcagctggggtaggagaaagacctcctctttcatgcacatctctgtattcccagcttgcaaaaagctgagggaagaatgattatttctattatctatctgattctctactaaagagacaaaatggacatctaaaaatcacaataacacaaaaactccacaatgtttaaatgctgtgagccgaagacggagggtcctccgagcctttgcctggccagagtacaggtgaaaagcacatgcctgaagagcgtggctctagcagtcccttcaaagatcatctagtacttcagtctgtgtggccaattccttttttttttttttttgagacggagtctcgctgtatcacccaggctggagtgcagtggcgtgatcttggctcactgcaacctctgcctcctgggtgcaagcaattctcctgcctcagccccccgagtagctgggattacagccacgcaccaccacgcccggctaatttttgtatttttttttttttagtagagatgggggtttcaccatggtgcccaggctggtctcaaactcctgacctcaagtgacccacccgcctcaacctcccaaagtgttgagattgcaagtgtgagcccccgtgcccggctgccaattccattttgacatgatattgtttcaatagaaaggctatttttacaaagtagaaagtgacagttagaggaaaatgataattttgagttttccatttcattttttaactgaagaaaagacaaaagctgtcatattccagctcctagcattattcaagaagaatgaattttctataaccattcctcgggcaaaccattcatttttacattcctgaagaattaactttgttaaaaaacaggatgtctttgttccagagtatcaaggttttgcttaacattgtgtgcaattttgcttctcatttcatttgcttcctatgagatttttttagcgctaagacagatcaaagaaggtttccttgttgcctttggctccactaccatttcctctcccagctcctcagctaactggttatttgcttggccagtagtgctatttgcaaacaggctcctgaacactgggagaagatggttgctggtaaattgcagcttgtgggaatgtctgcaacacacagctgactttctggaacgtggggaaccgctgacctcaaacgtaggttcaaggaggaaccacagcctgctgaggacccacactgaggtgctggtggatgcgggcagctgccaagctgatgaggaagggtttccaagaagcaggtcagggccccagcctggcaaaggggctctggggctctgggggagggaacgaagattgatgtcttttgcaggccgaccctgtgacccacacaaagccacaagaatgatatccctttcccttgctttctcctcttgccctgggacagtacttttcttccccattttcctagccttcttctgcaaacttcccggcatttaaaaaaaataaactttattttttagagcagttttaggttcatagcaaaggtgagcacaaagtacagagttcccacataactcctgtccccaaataggcgcagcctcccccatgaacatcctgcaccagagtggtccatttgtgaccatcaatgacccaacactgacacatcaatatcacctaaagtccatagtttacaatagggctcactcttggcactgcacattctatgggctttgacagatgtctaatgacaggtgctcactattatggtgtcacacagaggagtttcctgctccacctattcaaccctccccaacgccacattcagagcaggaggtgcctccaccacagcaaccactgatctttatactgattccataattctgccttttccaggatgtcatatagtgggaatcacagtatgtagccttttcagactgatttctttcactcagcaatacgtatgtaagtctcctctatgttgtgtcatgacttgatagctcatttcttttttagtactgaatactattccattttctggatgtttcacagcttatttatccattcacctactgaagaacatcttggttgcttccgagtttgggcaattatgaataaagctgctataaacatctgtgtgcaggttttcgtgtgaacataagttttcaacccaggaaaattccaaggagtgcaattgctatagcatatgggaagaggaggtgtcgttttgtaaggaactgccaaactgtcttccaaagtggctgttgcattttgcattcccaacagcaatgaacaagagtgtctgcttctgcagatcctggcccgctttgtgtattctcagggttgtggattttggccattctaaatggtgtgtagtggtttctcctccttttcatttgcatttccctaatgacatatgatgttgagcttctcttcaaatgccatctttgtatctttggtaagatgccttttcaaaacttttgctcatctttaataggattttgttttgttttgttttctattgagttttaagagttcttttgtattctgagtgacagcatttatcagatgtcttgcaaatgtcttctcccaatctgtgacttgtctgctcattctcttgactttcccaagcttttcaaagctcatagggagggcctgggactagagggaggctagtgagggacctagaacacagaatttaaagaggtgatctatctcagggccttgcaagtgcgatgagacacggccgagtgcctctttaaattctcacctaattctggtcctgctgatgtggtcagacctcagctgcactaatgtccagccccaccgtctactgagcaaactcgtcactctctgataggaccttttccgtgaccattgctgccaagacagcagcttcataaagaacaccaggccgggcacggtggctgatgcttgtgatcccagcactttgggaggccaaggcagtcggatcacctgaggtcaggagttagggaccagcctggccaacatggtgaaaccctgtctctactaaaaatacaaaaattagctgggcgtggtggcacatgcctgtaatcccagctacttgggaggctgaggcaggagaatggcttgaacccaggaggtggagtttgcagtgaactgagattgcatcactgcactccagcctgggtgacagagtgagactctatctcaaaaaaaaaaaaaaaaaaaaaaaaaaaaaaaaaaaaaaaaagaacttagaacccaaattagagactgtctttgggactgggagactttctcatgacaaacaagaggaagagaaatgcaccatcgctactcacagacctgagggaggctctgtcacttggcagcatgactttctgaaagctgtcttatctctcctagcctggggttttcacacctgtggaataggtaaaatgcacttaccccatgacatagttttttgtttgtttgtttgtttttgtttttttgagacagagtctcgctctgtctcccaggctggagtgcagtggcccaatctcagctcacgacaacctccgccttctgggttcaagcaattctcctgcctcagcctcccgagtagctgggactacaggtgtccgccaccatgcccagctaatttttgtatttttagtagagatggggtttcaccatattggccaggctggtctcaaactcctgaccttgtaatctgcccgcctcggcttcccaaagtgctgggattacaggcatgagccaccgcacctggccgacatagttttagatgaaatgagatcatgtgagtgaagggtttggaaaactgtctggtacggcacagggggctgtgaggaagtggcagctctgatcaccactgatgcatgcaggaaccagctgcggcagtcaatctgtgcttcagacttgtgctgcagaccatttacaatggcctctccccaggacactgttggaaactggaaggcttccgggtatgttaacttcatcagagaggaagactggagtatactgaactctttgaaaggaaaatcaggatccttagtttcaaccatgagactggatagtattttgtgatatcaaccaatacttccccattcaaggaagggatgggtgtgatgggttaaaatacagatatggggccgggcgtggtggctcatgcctataatctcagcactttgggaggccgaggtgggaggatcacctgaggtcaggagttcgataccagcccgacgaacatgaagaaaccccgtctctactacaaatacaaaattagctgggcgtggtggcacacacctgtaatcccagctactcaggaggctgaggcaggagaatggcttgaacccgggaggtggaggttgcagtgggctgagattgtgccatcgcactccagcctgggcaacaagagcgaaactctgtctcaacaacaacaacaaagacaacaacaacaacaacaacaaaaaaccagacatggcccaagagtctttctggcttttgtttccaaaagcctaaaccccagaggtgagaaagaattcagagtatcggaggaaaatgtcttggccagaagcaggaggaagaagagcattgcctgcaggaccggagagtgaccctctctgcaagctggggtggttgggggccacaaagccttgttaggagacgggggggggttacaagaccctagaacaaaatggccattgggtgccctgaagcggaggaggtcatgggcagtcttgtggagagttttgtgtccccaggcaggacccaagaccaccaacagcaaccagcctaaagggtccccacccagatgatggtgtcctacgggtcacccagtggacagatacctggtcctgtgtaagttctggggaaacactgaggcaacccaagcaggccaaacaggcagaatgcatgcttcgatttgcgttttaaaacatttagaaaagtcacttttccccgcatatctgaatatggggattgagactcgcatcagccctattcactttgatccgcaggtgctaggtggtggccctttttaaagacagcttccctgcaggaagcccagcctcctttctctgtatggcttctctcagggtttgccattcccttcacttttgcatttgtagagtcttcagcttcctttggttctgagcaggacccaggagatggacatgcatttcctctctgacaaaactggcacttgttctccttggaagcgataaagtcaaacatttgcttgaatttttttttttttttttttgcttttttgtttgtttgtttttagagatggggtctcactctgttgcctaggttggagtgcaatggtgcaatcacagctcattacagcctcaaactcttgggctcaagagatcctcccacttcagcctcctgggtagctgagaccctaggcacgtgccaccatgccccgccaattaaaaaaaaaatgaagacaggggcttgctttgttgcccaggctggtcttaaataactggcttcaagccatcctcccaccttggcctcccaaagtgctgggattacaggtgtgagtcaccataccaagttgggataactcttctgaaatgtcaaatgcaattacaagaagcaaaaaaattggtcccaacttctcccatatggtatgaaaaattaaagaatttcaatgcagttgcctttactctcggggacctaggcctcttccactcgcatgcttttgcttccactattttatctactttacccctccttgactcagcacccaacacttcttgtgaaaagccatctctgccctccttcaagggttcattctgaggctaccagcctctcaaatttttctttcttttttctttctttcttttttttttttttaagattgagtcttgctctgttgcccaggctgaagtgcagtggcatgatctcggctcactgcaagctccacctcctgggttcaagctattcttctgcttcagcgtcccgagtagctgggactagcatgccaccatgcccagctaagttttgtatttttagtaaagatggggttttaccatgttggctaggctggtctcgaactcctgacctcagataatctgcccgcctcagcctcccaaagtgctgggattacaggcatgagccaccatgcctggctcaaagctttcttgagctgggcagccaccttggtccctggacctgagcactccccttcatttctatgacacttctgggtttttactgtcttcatcacattgttcccctctacttatcctttctcatgttggtggacaatgaattatttccaatattttcttttgtacaatgatgttatgagcatgtctcttgcacgataatttttccagggtagatactacaataggattagagttggtgagtagagatgccacacatcttcacttttacacttccctgtctgttaaaatagaatgagtaacctccattccccataacttcacatacactaaacgcacactcacaaaagaggctggtcatctttcttcaagacattcaagaattctcttgtgggactatttcagaaaggtccccacattgtcagcaccttaaagctgccagatacacatcttcaaatgccgtaagtacttgaatgtttgctgctgaaaacagcagcctgtgactcaactacttgaataatcaagaccaacagcctgatgatgccacgctctcatcacttatcagatgccgtcatcaaggctgagcagcaacagccgggtgttttgtttgtcccgggaattctgacgaaagtacacggtttgcaaagtgccagccagcactgcctgagacagcaattcaaggcctctggagcagggtcgcctgtcatacgcaagtcctgtctgatggctcaagctgccccaggaatgaccagaaagtcaccgtgggagtgtggacgcagctcagaatgacctagacgcatggcctgtagacttgagggacacgggctctggaagaggaactctgaaatactactgtagctggtgttagaaaataatcaattgggtggccagaggctgagatggctgttttgcctaggattctgacctaagcaaactaaacccaactcaatgtcaacagtaaaatgaaacgtgagcctaaccaatcaccagctaatttctaatgagagactctcctttttttttttttgagacagagtcttgctctgtcaccccggctggagtgccgtggcacgatctcggctcactgcaagctctgcctcccaggttcaagcgattctcctgcctcagcctcctaagtagctggaattacaggcacgcaccaccatacccagctaatttttgtatttttaatagagatggggtttcaccaggttggccaggctggtctccagctcctgacctcaggtgatccgccctcctcggcctcccaaagtgctgggattacaggtgtgagccactgtgcccagctgagactctccactttaactgatcaagtattttttctttgtcttgcttccaagaacaccttataaatgtttacccctcacgccccctcagtggagccctgaacctcttgcagtttggtgctgtccaattaatgaatcaccctctgctcggataaactctctaaaattgtaatgtgcctaggttgatctttccacactggttacatgctgctctatcagctgagaacctctgggaagcaccgtcctggagcatgcagcactgagggctggtgggcattgatgctctgagcggaggctcggtgcctggaccctaaagtggcttctgcattaacactgtttgcatgcccagcgtagcttacttttttcttttctttctttctttttttttttttcagacagagtcttgctctgttgctcaggctagagtgcagtggtgctatcttggctcagtgcaacctcctcctgggttcaagcgattctcctgcctcagcctcccaagtagctgggattacaggtgtatgccaccacgcccagccaatttttgtatttttagtagagatggggtttcaccatgttggccaggctggtcttgaactcctgacctcaggtgatccacctgccttggcctcccaaagtgccgggattacaggcatgagccaccgcgcctggccagttttttctaattcctatgagtggcaatacgtggatgagttctcagttaaccaaaagatagcaagaatacttccttctgtgcacacctcaaacagcagagtttaagtgaagcctgggagggcctgggaggtcaccagcagagggctgtgtgcggaggcttgctgcttcccagctgaacagcccgtcatgcagggcaaggcttagttgacatgtttttccttctttctttttttaagagacaggttcttgctctgtcaaccaggctggggtgcagcggcaccatcatggctccctgcagccttaaactcctcctgggctcaagtcatcctcctgcctccttcctgaggagctgggattacaggcacacaccaccatgcccagctagttattttattttttgtagagacagggtctcactagattgcttaggctggtctccaactcctgggctcaagcgatcttcccaccctggcctcccaaagtgctgggattacaggcatgagccactgcacccggccaacatgtttctcatctgtgtgcaaagactgaatacctaggctgcaaaatgagctcccagaaatgaattagaaaattctgccttacaagtacaaacagagaagtggttctggagatgtggtttaaccaactggaaaaagtatttttcagacaggaggagtggatgaggagccaggagacttgcttttaatcctatttctatttttaaaaattatttgtatgactttgaacaaggttttttctctttgtgttttagtcttcccttttgtaactgtctgtcgtcttcctgccccaaaacgattagaattaagtaaaatgcctcagctgggaacaaaaccaagatgacgacttggcacattcctagaatattagacattgtcatcggcctttgttgagattaagtaacaacttaatggctcgattctgaaaaaacaaaagcaaaaagaaaaagaaaaaacgtagtcacgtagttttcattctagattagaagcatggatgaaaccgaaagactattcaaagaaaattgcttttaaaagaggaaggaagaactaatcttgaaggctgtcacccacggacactgctgatcatctgttccatacattcaaaggatctctctacggtggttattcagaccttgcagacaggctgatgtctgttgctcaagtacgccatgcatggaagagagtatattggcagcagtgaaaaaaaatataggactcatttaaaaagcctggaaataatctggatactttccaggaaaaacgatgtagagtctgacgcagttgttgttgttttaatgagtgacagcctgctgctggtccctgcgatatggttgttcatggagacttgtccctgagcagcagagctggtggtatgaatggcaggctggggatggagacaagcagggataagttccacttcttcccaggagccaaaaaagccacagatgacaagatctgccctctgtgccagcaccccttcacctgaaatgacagaacttctcatgtaccatatggcgggacagtgctgggaagcctccgagcaagacagtctgccagggaggctggctctggttatttctctttccactttattttaaaatttaaaaaatttttatttttgagacagggtctcattctgttgcccacgctggagtgcagtggtgcaatcatagctcactgcagccttgaactcctgggctcaagtgatcctcttgcctcagcctctcaagctgctgggactacaggtgcatgccactgtgcccagctaatttttaaaattttttgtagagacagaagttcactttgttgcccaggctggcctcaaacccttggcctcttgcaatcctcccacctcagcctcccaaagtgctgggattataggcataagccactgtgctcagcctatttctcctctcaaccaggagtcacctggtggtgggtgaagaagcagctggatgggagaagtccaaccaggataaggccataaaaagcaagaaaaatgtacacatggcccagctcatggacagtctttataagcaaatagggaaggataaaaagacgagaatccaaatgtgagaagcagaaaaataaagctctggtcctaggaaaggttcatggtgggaaatgggaggattcgaaatcagagagagctcagattggggtcctacaggatggcacagttagttccactggtcactaactagtccccactcctccagggagggtgagggatcagctagtctcaaaattaccctccacccctgcaccaggaagactcactctctgtaaagcttcccagtcaatgcccttgtgtcacgagtggttactgtctggggccagtggcacgggcagtaaaaagaatttgccaagacagtcataggtacagaaatgcagatttattagcaaaagcatggaaatatgttgcaagaaagcaataggccagttagcaagagaggagctgactggaggagacaaaggcttcctggggattttataggatggagcttgttctgtgtgctggagagggctaagtgcagtattgataatgtcaaggtggctgtgaactaacttgcatttttctatcaaccgagggtctggtgatatctgggtgcaggaagatcgtgagtcatttgcgcagatgggctatgtgtcctagactatgaagaaacgcagatttatagcttatctgtattttctttctgctttcccttgctcccaccagcctggctccttgttcctaattaggaccccacagtaaggctgccttcctttgctggctggacgcagtggctcacgcctgtaatcccagcactttgggaggctgaggcgggtggatcacctgaggttgggagtttgagatcagcctgaccaacatggagaaaccctgtttctactaaaaaatacaaaattagccaggcgtggtggtgcatgcctcctactcgggaggctgaggcagaagaatagcttgaacccaggaggcggaggttgcagtgagccaagatggtgccattgcactccagcctgcgcgacaagagcaaaactctgtctcaaaaaacaaaaaacaaaacaaaaaaaagaaatacttcctttgctgaagtcagcagctgatagaggaaggcaatacaaagccgggtatagacagtgaataaatttagaaaatgtaccagaacatggcattgttaatgaaccatggagcaccagaaatggaaggattttgcaaaccatggttccaatggttttaaagcgcaaagtttaaacatttataaattaggtcccttctaaagtcaatcagacaaacgcagtctcttacagcctcttatggtttggatatttggatatccaaatctcatattaaaatgtgattcctttgggaggctgagacgggtggatcacctgaggtcagcagttcgagaccagcctgaccaacatggagaaaccctgtctctactaaaaatacaaaatgattcaggtgtggtggtatgcgcctgtaatcccagctacttgggaggctgaggcaggagaatcacttaagcccaggaagtggaggttgcagtgagctgagatcgcaccactggactccagcctgggcaacaagagcaaaactccatctcggcggggaaaaatgtgattcctgatgtatggaggtggggcctggtgggaggcgtttgagtcatgggggtggagccctcctgaggcctccccagaagcagatgctggtgccatgcttgtacaacctgcagaactgtcggctaaataaacctcttttctttatcaatcactgagcctcaagtatttctttatagcaacacaaaaccaactaatacatggctgtattttcagtatctgtcgccacagaagatacaacacgacaaagctgtgattaattcagtaacatacttaaattcatctttattaatcccaaaggcatctatgcatacttgcaaattaatcagcaggatacaaacacatggcagtcgcaattgctctacacaggtttcctgggttgtgcacctgtattcagagaccccttgcagtggctctgaaggcccaccttccaccttgaggaagctgaagggcagaagactgaaggtaacttaacctccttaaccaaccagttagtgtttgagaacctggtattgctgcactgccaggggacacccaggtaatggccaggaaccctcctcttgctagacaggtaagcccagactagtgtagggaggaactggctctctctctgtagagggagaatatcctgagagacagggctgggctgttttcaccgtgcttcctcatacctgcccctcctctgaccagccagagttatccgcactgcctcaaggagaatgaggacgattacacagaagtgcaaagaggaattttgctttttacttccaaagcgggttcagaaagccttcttcaggaacaagttttagacgctaaagcctttgatttatttgaggaaggctctttgggggtctcagaaaaggggaaccccaaaggcaccaggtcctgcggtgaggcctggggcaaggtctaggggagccccgtgtagaggagagcagctggcactgagcagcaggcctgcattccctcatctttgccacatggggagcagtgcctgcagcaagccacggccacgcagaggcacggtgcccacgctgagacctcccatcagagacctcccatcagagacctgcgtatctccatgggtcctccagcagggcaattgcctgtgccctgagatgttggtgagcctcaatcacattcctccatacaacaatctcatgttaagaccagagatccgatgaacccccaaagcagggtgggatccccaatactgacaggcgatggcatgcggatgccccagtgttgtacttctgtacctgggagggacacatcggaactggattctgggaccctatttccttgtaagtgcattctaggtctttccctgctaccccagctgctacctcttacccctagggcaagaggataccctaggaacagtgtggagttcgagtggaagccctgggtgccgtccttgctcctctaggcaccttgtcctgatggtgattctcctttgaaccacagtctcctccttcaagaatggggataaagatccctgcctccccactgcactccagcctgggcgacagagccagactccgtctcaaaaaaaaaaaaaaaaatccctgcctcctggcatttctgtaaagatcaagtggacagggtacatgaatgcttttagcaaactgaaaaatgctaatcaaatgctagtgattgctcctttgaaaatccaagcacagcctgcaaaatacttggaatataaattgagcagacatatcgggagtagtttcaggttatgcttacgtgtcctttatttaaaaaaacaatgcttaaaacaccacctaaaaattcctctgaccacctatttcagtcaaacgctggaagatgggggatgctttatattaaagaattagaatgaggctgggcgcggtggctcacacctgtaatcccagcactttcggaggccaaggtggggggatcacttgaggccaggagttcaagaccagcctgggcaacatggcgaaaccccttctctacgaaaaatacaaaaattagctgggcgcggtggcgcgtgcctgcaataccagctactaggggaggctaaagcatgagaatcgcttgaacctgggaagtggaggttgcaatgagccgagattgcaccactgcactccagcctgggagacagagcaagaccttgtctcaaaaaaaaaaaaaaaaaaaaaattagaatgaggaaaacaatgatgaggtggaaacagatgtttgaacataggagaattttcgatgcataaggatgctgcgggcacttaaccagatgtctgcccttcactacctggccagggtggcacttttaaaccatctgataatggagagaggcggcacagtctgtatgggcacacagctcactctgtggctgaagccacatgtgggtgcactgggcccaaggagctgacctctgctcttgtggcactcccagtccggcacagacttgaggagaccaccgaaaaggagcccaggccaatggcctgcaaagccacttccctctacttgaccaagaagagcttcccggaccctggctcctgcctgcgcatctggccagcttcatcttccaatgctcctggtctccgataagccccagctgctggactgctgtttttaaaccccttccaggcgggaggaacagaagagaggtgagtggacaggtgcaggccctggagcctgaatctgctcctttctagctccggaaatgtgggtaattcccttcacctcctgctttcttcccttcaaaatagaggaatggttgtattggtttctattgtggctacaacacattaccatatatttatggcttaaaacaatgcagttttattattttacagttctggagttcaaaagtctgaaatgggtctcgatggactaaaatcaaggtgccaggagggctgtgggtggaagctctggggagagttcgtatttctgccttttccagtgtctacagccatctgcaatcctgagcttgtggctcctcctgcatttttttttttttttaacattttactttaagttctgggatacatgtgcagaacgtgcaggtgtgttacatagatatacgtgtgccatggtggtttgctgcacctatcaacccatcatctaggttttaagccttgcctgcattaggtatttgtcctaatgctctccctgcccttgcccctcaccccccaacagggctcggtgtgtgatgttcccctccctgtgtccatgtgttctcattgttcaactcccatttatgagtgagaacatgcgatgtttggttttctgttcctgtgttagtttgctgagaatgatggtttccagcttcatccatgtccctgcaaaggacatgaactcattcttttttatggctgcatagtaatccatggtgtatatgtgccacattttctttatccagtctatcattgatgggcatttgggttggttccaagtctttgctattgtaaatagtgctgcaataaacatacatgtgcatgtgtctttatagtagaattatttataatcctttgggtatatacccagtaacgggccctcctgcatttttaaagccagcccagcagcatcccccaccttctctctcagatgcgcctatcttcctcttatgagaacctttgtgacgacactgggcctgccaggtattccaggatcacctccccatctcaggatctttccgttaatcacatctgcaaaatcttttttgctgtgtaagattcacagattcacaagttccaaggattagagggtggccatctttggggaccatgattctacctaccacagtagtcatcaggaataagtagttcatacaacataagccactaagagcctgggctgcaggaagcacttaattaatgtgagccataatcattctcccttgctgaaacagagcccccagcctggaaggctttcgccttgcactggctgtgccccaatagttccatctggccaaatcatgagacctccttccagatgccttccctgtccttctgggccgggcttggtgtccttctgtgttgaggtgggagcttttcttaattccgtgttgtatgctttttttttctgagacagagtcttactctgtcgcccaggctggagtgcagtggcactatcttagctcactgcaacctctgcctcctgggttcaggcgattctcctgcctcacaaccagctaatttttgtattttcagtagagacggggtttcacccacgttggccaggctggtcttgaactcccaatctcaggtgatctgcccgccttggtctcccaaagtgctgggatatcaggcgtgagccaccgtgccccgctctgtgttgtgttataatcctctgtctccctcactggattgtaaatgcctcaggagcagggatggcctctgacttattttgcattcctacccctaggacatggcacacagcagctgtcaaatgtctcctggacggctcatgggtgaaggtaggtctgtgtcctttggggtgtccagaacctcagagctgccgttgctgctgtgggaggggagcagtgagggggtctctaggtggggatcttgtgctctgacagaggcagctcttcagggtggtagctggtttccccacagagaaggctgtctctcaccccaggcagaagaggacagatccatgcattcagcctggggaggagacctggtgttgcaggcacatcatgcttacggtggtcaaaccctcacagccccacgaggagcgggagaggctggcataggacacaagagcctggggatgcttaggcaggttggggggaatcagatatcaggaataaggacccacagaaatcatttggttcaatgcatctcaaatctggtggctgcaaaactcaaagactaattcccggaccctagcccagacccactatgtcagaatgtccaggggatgaggcccaagaagggatattttaaaaactgcccaaaatgtatgcagccaggtttgagaaccactgctgcatctaccttaggctttatacacagactgtgctacaagtaaatggttctcaaaacaggtgtgtaaaacagaagaaaggatacacacatcattcaacagactacagtgaacctgccagaccacgcatcaaggcgaatacataagacagtccttgccaagctgcgtccttgagcccgcctgaatcccggcagggtggagttgagggcggcctctctacttcatttagcccaccagaccttcggacctgagggtctctgatccagcctctcggggccaccaccccctgcagggctccaggaagagtcaaattgcccggtgggccagagctctccctcccttttgttgccgcttggcgcctggcaggtcagaggtcactgggcccagcagccccagtccctggatgggtggagcacccacaaaacagccaggctgtgaagaggcccactttggagtgagaaggggctgcttcttgcgtgtcattttgcaaaaagaatctctgtctcttcctctaccttgagttacactaccaaatactccttttggttaatgtagctttcttatatgctaggggtgagaggaggggaaagccaccttattctgtcaggaaggcacttgggcataaattaatctgtaggccaagtgcagtggctgatgcctgtaattatgcactttgggaggccgaagtgggaggatcacttgaggccaggagttccagaccagcctgggcaacatagtgagaacccatctctacaaaaagttttaaaagaatttagccgggcatggtggtgggcaactgtagccccagctacttaggagactgaagtggaaggctcacttgaactggggagctcaagattgcaatgaaataccatcacatcactgcacaccagcctgggcaacagagcaagaccctgcctctaaaactaaataaataatcggcggggcacagtggctcacgcccgtaatcccagcactttgggaggccgaggcaggcggatcacctgaggtcaggagttctagaccagcctggccaacatggtgaaaccctgtctctactaaaaatacaaaaaattagctggcgtggtggcgggcgcctgtaatcccagccgctagggaggctgaggcaggagaatggcttgaacctgggaggtgcaggttgcagtgagccgagatcgcgccactgcactccaacttgggtgacagagcaagactccacctaaaaatataaataaataaataatctgtgactccatcaacactttcacctgttggctccacgtgcatcagatgagctcatttgggaggtcaccttaacctcggatcaacatggcaggtcctcccacaagcagcctatttaaaatgtgagccacccccttccccggaattccctacctcccagccttgttttatttttctctcatgcacttactatatcttaaatgcttatttattcatgtacttgtttaaactacttttgattttctgacttcttatcattggtctgattcctccaccgtaacagaacttccatgagggcggggatttttcgcttcccccgcaactgcctgcgttttcgtagccctagagcttccaacgtacagtgcggaaaagcaacataacacactaagaaccgtgcggaaaaggagagaaaaccagaccgcaggggcatttcacagctaaccacagcggtccgaggcgaacgcagggtggaagaacccgagcgaggcccggcaggggcggggtgagccttggccccgctcccgtgcaggtgtcgcgggtaagctgccgcggttactgtgaagcagggccaaggccagccctccgcctcgaggccactggtgcttgggggtgggaaaagagtgaccgggggcaactgagcaaaacatagaacagaaactccctctcgaatagagacccacgcacggaaggatgatacactgtgattccccgacgtgggcctgcagcaagagacgggtgctaacagcgtccgagccaatccgtaagcatcagagggacaaagaaatcataaacaagaggcaggatgcaactgcttcaacgcagaaagaatgagtcatccaggaaggcgaggtggtggcgggttggctgtggttttgcagaggcgggcaggaggggcagggggccagggagagggcagggttgggagggtctcttttaagggaatcctatgcatgaaagtctgtgtaagaaagggtgtgcctcctacagaaggatatttgttttgtcctaaacttgccgtgtgttcttggaggcgcgggcctccctgctgtcatcacacctcggatcaccccaggcaatctcgcccctgtggcttcacctgggtccagccagacctctgctcagctctgcacgtacatgccccctcgatgtcacctcctgacttggcaagtcatacaccctctctctacttgcccagcttcattcacaaaaccaggtcacattacccctcgtccatccatgctcagtctggaaaccctgggatcccagacaccagcctctccctggccctctgtttccaatcagacggccaccccgactgacgctggggccggggcacccttgggcgttatccagtctccctgtcctccctctcctgccccacgcctccgaccttccccacatggcagtcacagccagacggccaaggtggggcctgctgcttcctgcttctgcctgacaatggccctggattccccattcttcacggtcagtctcaccttcacaccccggctctgagcaacctttctgctctctccactcctctttcatgaccctgggcccctgctggccgccctgcctggaaagccctttctcatttgtctggcttgaaaaacctgcctcagctcaccagggccagctcaagactccctctgttgtcacacgctttctgcactgctatcagaaagaactaacactctccctgtctgtgcactaatccagggtaggtgggctgttttcacacatgcaccccctctaggttctgactcctctggagtgcatgaccatatcttatttgtttccctgtcaccagtgcctaaactatctgatgcatatatttattgcaggtgcttatcacacatgcagtcaatgaacacctcacaaatgcaaggttcacatgcagtcttcgatgaacacatcgatcgcatccagcagtatgtctgtattggaaaagtccttccatagcacccagtaatgaaaaggaatgtggcggggagcagtactggacagtaaaactaaaaacaccaggaagatcacagtgagatcagcagagccctagaatggcaaatccatgacaaagaaaatttctgatgaataaaaacgtgcctgggtccaggccagcaattggcttctttcagacactattgactgcaacaaaccctagcacaaggagagggtctaacgagaaacttgttcagaggatgctgacccatccatcagtgagcacagccaacccaaaaaggcggggacgcggcagagcaggggctgagggcacacttgctgcagtgttcacggagcacacacagaaagatctgcccgagagagtccccaaaaggcacaattctacaaggtcaaccaagtggaggggaatggcagtgaaacgccaaactcctactgaaaggttgatgggtacagccttccagagacagggctgggtggcgggaacgcgggcacccagaggtccagatcagcaaaagaggccagtgactctgtctccatcagataaaattcagccacagcgggagggagcgtgtgagacccacgaaggccttgccctggacctacacctcaccctgttccagagagaattcagtggccggcaacactgccagttcccctttatttcccttgaggtcaacattttggaattttctactcacatccaccgagcgaccctcctcggccacctccacacccacactccaggcccaccactgcccttgggcatgagcaagcctgacgctgtctctcatcctggtaacaccttcttccccgcacacaccgtcaaacacatgcacggtgtagactgaagtcatcaggtctccttaaccaggctgcagtcccctagtaccctgccatgcagccccacagctgccggggggataaacaagcaccttcagactagagcagcttctgagtgatacgcaaagttaactggggcacagagaaaacagaattttcccaagattgctgaaggaaaactaaaaccgaatgaggactgactcatgctcgtttagtcggccacaggctaggggcagcggaaaggccctgctggaaatttccatccagggtctgtgcagggcgggtaccccagagccgcagggcagggcagatggctcctcagatcgggctggagagacatccaggaggaggatgccagttgttgggtgtagctggaccttcctatagacagggagccatgggaagacagagaccactgatgaggaaggggagatgcagcagcagacactccgtccacatgggccccgggccgccagagaccccagggcccacgtggacgtgtgggtgttgaagggtaacacgtagccctttccaaggtgtgttgatgacttggctcagcctgcaaagccaggctgcctgtactgctgcctgacctctggcctctggcctccaagagcctgaccctctgggaagacagagtcccagcatggggcatgaccaccccatctgctcttcctgttcatcagtgtctggacctgagccacagagtcctgctgggccattgtggagaagaacctgctctcagccctcagcagcctccctgccctgccctgcctcccaccccaatctcaacagcctcttgctcttttcttcccgccatctaagctcatttctcctctttgggccttcatacatgggtactgctttgctagaaatctctcaattttacctctctgtgtggtgggacaccagaagaaacaaggttgagtttgggtgctggaatttggaggaacatgtaaacactttttctgctgtagttgtagaggtgcttgaataagaatgttcaggctgggcatggtggctcacacctgtaatcccagcactctgggaggccgagtcaggtggatcacctgaggtcaggagttcgagaccagcctgaccaacgtggagaaaccccgtctctactaaaaatacaaaattagccgggcgcggtggcacatgcctgtaatcccagctacttgggaggccaaggcaggagaatcgcttgagcccaggaggcggaggttgcagtgagccaagatcgtgccattgctctccagcctgggagacaagagggaaactcagtctcaaaaaaaaaaaaaaaaaaaaaaaaagaatgtttaaaaagagttaaaaatgttttccttcttcctattttatcgccctgcctctctttctttgttggagcccatatggaggggacagaagacaaggccttacagctgtacattaggcaggggcaccaggaggaggtccaggcactgatgagaaaggcataaaggcacagttaatgccagctcatatgatccatcgtggctgttgtcccgcctcatgcacagggggtgttggggaagaaacaatctctctggcccagagggatacttagagtgcttcttctatctctagggccttccatggcctcagagcacatgtgtcacaccacagaaagccaacccagcaactcagagagaaatggttttagaaatctaagaagcaagagaaacaaatcctcctgggaaaggagctcatgtgcagtgcctgagtgtgggtctctctacagttctccacttttttctcttccacacgtctctgtcactttcacttgtcatttgtgtatacttttcctacatcagttaaaaaaggttcccaccacccaccaaacccgctgccagaacactcctggacagagaggacacaagcagtcactgctgttttttgcaaattagaaacttggcaggtatcctgtgagtatcaaaggagatcatccacatgacacgtctagcccaatcattgcccttctttccccttgttgcccactaacctgggctcctagccctatccgatcctcggagactgggcctttggtgacccacaaacctcacggccatggagacgaacagttcctccatagctccctatacttcctcactcctgggcacccagggctccttccccagtgagcacggcgtcttgcacacagccggctttcccttatctgcatggcacctgtcactctgtctaccaatttccagcagggaatctgattgcccaccagccaccattcagtctaacaagaactccttggcaattagaggaatttggaacgctccagcaagctcactgaactgatctctttttaagcacccattgttttctctgcagtaatttttttctttcagcagcttttctagcccctatttcttaacatttcctaaaatgaaaatttcatttgtgtttttacttttgatcatttattaacagtctttggcttattctttagaggtttttaaccagcttctttcagtctttcggtagtattaccctgcaatctccttttctttcctgataccatttagcttttctgactttcaattaaaatatccttgctatccactgttgataggttatttatgtagtacttatacctctattaaaggagttaaattttggtttctggttttaaaaaagaaacaatctctctacctgaataatacaagtctctatgcctaagtatatctagaatgaataaaaataccaaattttaaaaaaggaaaaccagcaagattagatagcagtatatccttaaaaggtgtttcaagaacaaaaatcaggtaatattttaaagttactacttcaaaattccacgaagaaaggggcaatcttctgacatacattattaggcattctcccctctccaagcagaaactgagacaaactaggaaaaatgtgatagtgaaataagtgagatgcagctataaataaaagaagaaattgttgggtacagaccttagtctttgctttctgcataagcagtagttttgtggtaggcgtgggtttgggcgtgtaggtcttgggggaaggagcattgtacacattttacagtgttcctgccctcctgagacagctgtggctcttgcttccccaggggtcagggtccatgttcccacctcatgttgtttatttattttgaggccagagtgcagtggcaccatctcagctcactgcaacctctgcctcccaggttcaagtgattctcgtgcctcagcctcccaagtagctgggattacaggcgtgcaccaccacgcccgcctaattttttgcatttttagtagatacggggtttcaccacgttggccaggccggtatcggactcctgacctcaagtgatctgcctgcctcggcctctgaaagtgctgggattacaggcgatgttcccacctgatgttctatcatttcaaagaatgcactgaatattgggggacttcagggactgtcacttttgctttaaaaactgtaaagtgaatctaggaaaagctttttttttttctggtttctccaccatcagtttgcatgagaaacgccaatcataggactgctgggaatggccccttagctgtgctgtttctgagccaggcctacatcctccactggcttccttgggcgaattttaaggcctatgagcactggagttgtgcatggaggtgggggccaacaggaagtccattgtcctaaatagtcatttcagcctaactaaccccatggtgaggctgctcattaacaggcaaggcatcactgtaaaccttgcatttgcatttacacctactatttattaagtgccacagccatctcttatcatgaccggtcactgagcaaaccctacatttcaaaaacaatccagtttataggtcctctgtctgtttctccgggctggaaaaggctttccatttatcaacttagttgtccccccagtcgcctcttgcagggaacagggccagatcagatggcggctggttcccctcccccgcctcatacaaaaatcaggaaaaggagttgcgggaggaatcgagaagccggccgcagagcccaggtcccccatggctactgtgaggcattcgccgctgcaaatttcctgtccactgtgggaagcggcacacctcactcatgagcagacgacaggactggcacgttttaatggagcacacgggcgcagcctaggcggccttttgctccggctgagaggcacgggcccggtgccagcatttgacagtcctgggaggcgacgggtagaggagagacgcggcagccgcggggccggggagacggtgggaggcccggcgtccatcatccactttattacttgatcaaactttaacattttcgggtttcctaacaccttagccccaaatactcgaaatgaagcaaatcttaaattaaggagtctttccccaccacgctctgtcctcctccccacttcaccctcccgccgtttcgcgttatttccaaggcaatttaaaaaatcaagccaaacaaagctccccggttgctgccgggcgcgcgcggcgaacgaagcacatttcagttcagcaccagcctcggggacagacgccatcaaggaggtgaggaaaaccaccctcagctgcggtggctccagcgtcaccccgagtgctcccgaggcggcgtctgggctgctggggagccaggagggcttcctcaggcactcgccagaaacatttccccaaagaaaacgcccaaccagccacgccatctcctgccactgaggtccttttccacgggggacgtccccgctgggaaaacagcaaacgctctgtgacctacaaatggaagaggggacccccgagcccccgcctgcctcatgccggagggaccgggcgcccccagccccggaagcccctggacgcgctccgagggggctgtccacacccgcgcgcgggcttccccggggcccggcgggaggtcccgggagaggaggccgagggaaccacaggtctttgtgtcgcgtgcagcagcagctggcggcgtgaggaccacaccggcgccagagccgtctccctaggtccggagactttcaccccgagtttcccttccgcgtctggctgcaccgggctgggctctccccgcggacacccggggctccggccgggcgcccacttacccggagcgggatcacgcgcgggcttcgtctgcagcgcggtgctcgcggggggcggccaggccgagcggcatcgctccgcatcggggcgcgggccgggctcgggtgcaaacgcgcgcctcgtgcccctcccgccgcccgcggggtctccgcgtcccgtcaccggccccgccccgcgccgcgcctcccgccctgcagggcccgaccacgcgggcctgggggcgcaggcggaccctcccccggccctggacgctgggggcttctgctcggccccctgtgccgtgggggcccagactggggaagggagagccggcgactctgcgaccctcgcccccgttccacgctggccgcgcccactccgccgcggggtctcgcccgggaaatcccgcccgctgccaccgacgtcactgctgcgtcaccggggctcccgcgctccccgcccccgcccccgccccagcccgggcccgcgccccccgcccgctactcgggcccacgccccctgtcccagcaaagggccgcgcccccgccccgcccccccggagcccgcgtggccgggggaccactggaggggtctgtggggcggggccggggggtaaatcactgggggggggtctggggggcgcggcgggggggagatcactggagggatctgcggggcggggccgggggggaaatcaccggaggggtctggggcggggccggggttgctggaggggtctggggacggggccgcggtcagcgcgggctccccgaagcctcaggtaccgccctcgctcggggtgagctccagcgcctgggccgttggggcgcgggccgcttcccaccctgcaccaagggacgcctcggaagcctccggccaaggcggggaacggcggagaaacgcggaatacctgtgcgaattcgcgcggccgcgtcgccactaacccggcgaaggctgacccgacgttgctgagtgacggggaccaggggccggcgaggcccccactccggggggagcgaggccgggagggcggagggcgcgtgctggaggcgggggtgcccttcgcgccccggttctaggagcgactgctctccaggcctcgtccctgtggcaccg

SEQ ID NO: 886 - DNA, 102310 bp, Homo sapiens
attgctagtcacaaagcccaactttttattgaagtataacatacacacagaaaagtgcccagatcaaaagtgtacagctccaagaatgttcacaaacggaaagcacccaggtaaccggcaaccagatcaagaaacagaacaccccagaagcaccacctcatgcccgcttctggttactgtcttcttaggactgatctctacttgcaaccgcatggatgaattttgctgggttttaaactttatataaatggaatcctatggtgcatttttgccttatctcgttcaacactagggttggtgaatacactccaagttgggggtggagttgcagctcattcccattgcagtctgggattccatcgtgtgaatataccctaatgtgcttatccagccaacatgggcattggggtgctttcctgttcggggttattatggagagtgtttttgtgaagatttagagcatgtctctggatgaacacatgtacacatttctgtagggtatacacctaggggtggaattgttaggtcatatatatttacatccaactcaagctctttcatgaaagaagaaagaatgtactggatggagtttgctggctcaaagaattgacagaaaactagaagggaggtctgtaggaagataggtggaggcggagacagctcagcgagtccaaggagtggagcagaaatgacattcccaggacgctgccatccctggacattgctaccagtggacacaccatccctgcagcctgccagccctacccacctgccttgctgtatgactaccaaccccggaccacggtggcttccttgaaatgagtctcagcatcccttcatttgtgtcacattctccaggctcatagccccaagcaagggtccaggtagtccaccccaggtcaatgaccacttcccgactggtatggggctggaagcggggtgtgcctgagagacaggaaatacttcccttcttcagcttccacggtgggtactgcacaccactaagtttatatctaaggcatgatgtccctgctgtaggaagggaggggagatgctggacagttaagctgaaaacacaaaaatgacaactgtccccacagctgcactccacaatgcaagcaggctttattccattcatcttccactgacagagtgggggagctcagtgacatgtctgtggatctcacagctcatgtgcagaaatctccatctaagaagagggaactaggccaggcgcggtggctcatgcctgtaatcccagcactttgggaggccaaggcgggcggatcacttgaggtctgggcttcaagaccagcgtggccaacatggtgaaactccgtctctactaaaaatacaaaaattagccgggtgtggtggcgggcgcctgcaatcccagctcctcgtgaggttgaggcacaagaatcgcttgaacccaggaggcagaggttgcagtgagccaagattgcgctactgcactccagcctggacgacagaaagagactctgtctcaaaaacaaaaacaaaaacaaaaaaagaagaggcagctggattcaggatcactctaggaagggtgacccgtccccaaatgccataggtctggaagaggtgcagtaaaaggacagaaaagcatctcacaggggaaggtaaggaagagaggaggaaaaggaaaaggagagagaacaaaacggaggctgaatctggagggacggggcatgtaaaaacaacagggagaaggtttggtggaagaggaaagcagcatttttctgacctgattttgatgctctctgtacggccccgctttctcggcttctctgatgtgcctttatgacttgtgcttcgcttcatcgggttaatgatgttgacgtgaagcacagaataaagagatcctggtcataactgcactatcaaaggatctgaggtcctagcgtcacatccagcatacaattctgctctagtttgagcatcttaacaacactggtattattagtgagctgataatgaaactaagaatgagttttaacaaaagaagcaaggaacaaagatgtcctaaatccatttacgagggcagcaagtcattaattggtctggaaattacatttgcctctttgcaggcaattttatgcctccaacggaaccatggtctctttgaagtcatccattcttccctatattataccacggcatttagtacatttatttgttttaaatgataatcagagctttcatctatgtagcatctctgtttcctcccagacagaaaggcaggataattaccattaaacccaatttgcaggttagaacatttcaggcacaaatggcctgttctctatcacacagcaagtctctttcagaactagggagagaggcagtttccaaataaacagaatagaacaaacttacacaaagagctctgctcccactgtgtattctcctctttcatcgggatcatatgagtttggtttaggtaggaccttcaggttgatcttagacaatccaagagctaattcatcgatgtctagcctttccttggggcatccatgaatcaccttccttaaactaccagaatacggcttcctcctggagaatgtgggaagtgaagtgtgccacgggttactgcaacaaaggtgtttgcttcacggtgtgcagttatgatagtttgtgggtctccctacctgcaaacaggtagacctggaaggtagcacagttcagggggctaagggaactctggggccgggctgcctgccctcaaatcccagtttttctgcttaccatgtgtaaccttgggcaaactacataaacgctttgtgcctcagtttcccctcactctaagacatacggccgggtgcactggctcacacctgcaatcccagcactttgggaggccaaggtgggcagatcactcgaggccagtagttggagaccagcctggccgacatggtgaaaccccgtctctactaaaaatacaaaaatgagccaggcatgttggcgtgtgcttgtcatcccagctactagggaggctgagacatgaggatcacttgaacctgcgagtggaggttgcggtgagctgagattgtgccattgcattccagcccgggcgacagagcaagactctgtctcaaaaagataaataaataaaataaaacagacatgcacttatggtatttattgttggaagattgagtaccttaatgcacaccaatgctcagatgacttgggggcacataggggactgctgtcaccatgcctcactcctgcagggaaggggctgccctactaaaaccccagcgggcccagtgctgtgtccagaacaggtccttatattactgcagcccacaatggaactactgagtaggagccaaaagaggagggagcaggaagaggtggcatttggagaggggagaccgcacccacaggtctgccacagcgcgtcaacggtatggggtacttttacagtcaagttgacttcggtgtccgcccaccatctacctttgtaggaccactgaaacaagggacatccaccacggcccacagccggggcgccacggccccaggaggatatgctaagaaaaccattccacggccgggtgtggtggctcacgcctgtaatcccagcgctttgggaggccgaggcgggtggatcacgaggtcaggagtttgagaccagcctgaccaacatggtgaaaccccgtctttactaaaaatacaaaaaattagctgggtgtggtggcgcgtgcctatgatcccagctactcaggaggctgaggcaggagaatcgcttgaacccaggaggtggaggtcgcagtgagctgaggtcacgccattgcactccagcctgggtgacagagcgagactccatctcaaaacaacaacaacaacaaaaaaaaaacaaaagaaaaccattccaatcctgtgggttgttgtctttttactaggatgatggaaatgcaggaaatacagaacctctgcagctgctttctccaggaaaggagatgaaaacgttatatgtttcagttggtcaaaatgctctaatttgatactgaatattgcaaataagggatatttaggcatagttttttttttaaaataaattatccactgaaatgtattaatatgatataaacttggaaactgatgtttaaaaattttaaactcttaagtccagacttacttttacatggcacatttgttatttggctataaacattttgattttctttgccaataatgaaaataacatgaaaatgaaaaggaaaaaaatgaaattgaatgccacgaagaaaacagatggaaacataagacaagccccggccactgttggctgggcagggatgggtgttggtctcactccctaaggcttagagcatgcatggtctctacaggggactttgaaggtcagaaaaggaggcgttttcatcacacacggagttagagaatggtacaaaagaacttcttctcgcgaaaggggttttctgatgcaggcactggaatgatgagaggatcttcccgcacgtgagcttcacagtaggccaggaggtccgcagctgcctgggagacctgtgagggcacagagcacaggtgctcagttaaaggcccctttgcagagtgagtccagggaagaggtgtccacgtacagaggggacaagccctagggtaggctgtattgtgtgcacggcctacaacatggtcatgcccaggctggagggagggtttgtgcagatctaggagactggttcgaagcgggcctccaagaaggggaggctgccctcgcatggcaggccagcatggagacaggactgagggctggcaggaggcccagacagccttgatatattctcgagtaggtgaggagtggaggttccaggacagtagtctcacaatgactttgctaaaccgtttctggaagactaaagcagaaggcagcccctggccaagccagtgtgatcatatttattatcattattagttgttttattgcaatccactcttgtgaccaacacagagagacacttcatcctcctcaacagaacttgtatttagctatattttataagcacacgttttatttttattcatttttcatttttatttctttttttgaggcagagtctcgctctgttgcccaggctagagtgtggtggcgtgatctccgctcactgcaacctccatctcctgggttcaagtgatgctcctgcctcagtctcccaagtagctgagattacaggcactcaccatgcccagctaatttttgtatttttagtagagatggggtttcactatgttggccaggctggtctcaaactcctgacctcaggtgatctgcccacctcggcttcccaaagtgctgggattacaggcatgagccaccgtgcccagccagcacacatgttttaacttggagtggccacttccctgcggagagaggtgctcctgaccagaaagttctttccattccatttctttccaggcttatctgaagcctgctggcgcatggcagttgtgcatcaaactgtccccaagctcaaggccagaggaagagcaggttgggagagggcggggtgcggacaagcatttgctaagagggagaggcagttaccagcttattttgttcatggtctgtgtcatgtgcttggcagataaatggcctgtgcattaactcatcctgccaattaggctgttctgcctgcgagtatttattagcggattacaggcaggggtaaatacatagcagtcaaatgaaatccttttagtacattcaatgtctaaatcttccccagaatgataaaaatgttccacagatgaagaaaaaaaatgtttagaagcctccagctacacaggccatacacattcccttctgggttttaaaaattggctcatctttcagcattttacagagattcttctgattttcagacctaaccgctttagcaatggctagaaataattccagcagagatatacaatgaatcaactaaacacatcactcaaataaatcaacttgaagtttagcagatgagttagtctaaatcctgacaaaacctacatttgttaagaatgtggcatggagaaatgagttccggtgaacatcaggcttctagatctacccccgcccgtaagctagctgtgtgaccttgggtaagcagctcaacctttctgagcttcacttccctcatttgtaaaattcaggagcgttggagagctctaaggtcccaatttactctaagacgtctatgattctacctttaatagcatggtcagtatttaagatcctaaaaacgtgtatgttgagttgaataggagtgtttgaagtttgcagtgggttacaggacgcccatataggaatttcccagatgggtgaggctcaggggaaaactgagcctgtggggggcctgtgaagccatcacaaggagcaggagcacaggcttaaggaaatggactctgaggcccacagggctgcgatggacacacaagagaatggaatcacatggtgagtgctgcaactcaaagccggtggacttgggagattgagccctcccttgctgccaccttctaaggaaagccaagtgccctccccaactgctggagtgatgacctccttagtttccactcctggcttctcaccatgcccagagatgcagaagctgctgaggtctggggtctccctcatggccaccatgttaggacagccactaaattcatccattgacccctctggcaacccctgggcagtggtcttcactgctgcctgggcagcacacacaagggctgcagtgttggaacaaccacattcctcctctaggagccactgtcctcttgggtttgctaagtctaggcccctgactccagtgagctcttctgggagttccgtttaagaatggctcggctggacgcagtggctcacacctgtaatcccagcactttgggaggccaaggcgggtggatcgcctgaggtcaggagttcaagaccagcctggccaacatggtgaaaccccgtctctacaaaaaatacaaaaaattagccaggcgtggtggcgggtgcctgtaatcccagctactcaggaggctgaggcaggagaatcgcttgaactcgggagttggaagttgcaatgagctgagattgtgccactgcactccagtctgggcaacaagagtgaaactccatctcaaaaaaaaaaaaaaaaaaaaagaacgtctcgtctgactatcatgccctctccagttttctagttttcacttttcccatctacttcattttttttggacatgctccagtttcatctgaattctctataatcctcgttatgtcattcagaaaggaagtattcactatctaccctttagctaattcagaggatgcaagagaaagaataaggcaacagttttgccctctagaagatctcactgtgatctcaaacatgatgaagtcactataataatccatgtgtgctgaaatgtcacaaaagaacacttgcacgccactgtggatccatgatgagaggccaggagacggggcatctgacaacctgtccagtcccagacagtagaggacaccttggtgaatctgccccctttcttcagagggcaatcactggacttctgggcccagaaacacaatttcctggcacactcagaatagatcatctcttgtggctgacccatattaaacaagctcaggaggcagctggataaaaccataatacaaatagaagctaacatttacatttactgagtgcttctcaggtgccagcactatgctacatgcatcagatgtattatgtcatttaattcttcttatacgtacgactctagcctgggcaacataacaagactctaccataaaatgaaaaaattagccaggcatgatagtgcacaccggcagtcccagctacttgggaggctgaggcagggacatcgcttgagtccgggagttcaaggctgcagtgagctgtgatcgcaccactgcacaccagcctgggtggcagagcaagaccctgtctctaaaaaaaaaaaaaaaaagtagaattccttatttataattgacaaataaaaatggaatatatttatggtgtacaacatgatgttttgatacgtgtatacattatagaatggctaaatcaagctaactgacatatctattacctcacatactttttttgtggttaaaaacataaaatttactcttttagcaattttcttttttcttttgagatggagtctcactctgccatccagactggagtgcagtagggcgatctcagctcactgtaacctctgcctcctggtttcaaacagttttcctgcctcagccttctagtagctggggttacaggctcctgccaccatgcctggctaatttttaaatttttggtagagatggggtttctccatgttggccgggctggtctcgaactcctgacctcaggtgatctgcccgcctcggcctctcaaagtgctgggattacaggcatgagcctctgagtctggcaagcaattttcaagtacacatgataagtattatcttaaagccactttacagatgaggaaactgaggcacaaaggttaagaaggtcacccatctattaagagaggaaaccagggccgggcacggtggctcacggactgtaatcccagcactttggggggccgaggcaggcagatcacaaaatcaggagctcaagaacatcctggccaacatggtgaaaccccgtctctactaaaaatacaaaatttagctgggcgtggtggcccatgcctgtaatcccagctactcgggaggctgaggcaggagaattgcttgaaccagggagtcagaggttgcagtgagctgaggtcgcgccactgcactccagcctggcgacagagtgagactctgtctcaaaaaaaaaaaaaaaaaaaaaagagacagccagaatttgaagctaagctgtactgtactacagccgtccccaacgttttcggcacgagggagtggtttcgtggaagacagtttttccatgaactgggggtggggggatggtttcaggaggattcaagtgcattagatttatcgtacactttatttctgttattattacattgtaatacataatgaaataattatatacaattcaccataatgcagaatcaatgggaggcctgagcttgtttttctgcaactagatggtcccatttggaggtgatgggagacagtgacagataatcagacacaggattctcataaggagcttgcaacctagatccctcacacgcgcagttcacaattgggtttgtgctcctgtaagaatctaatgccgctgctgatctcacaggaggcagagctcaagcggtaatgcaaccaatggggagcacctgtaaatacagatgaagctttgcttgctcacccgctgctcacttcctgctgtgcggcccggttcctaacaggccacagactggtactggtccatggcccggcggttggggacccgttttatactacacagaatctacactcgatacagaatctataatctacactgtatacagaatctatactcagccgctatactacagcagctgctttgttaattgacaatgagacccgtaattctcaagtggcctggaacattctcacctgcccatccatccagtgcacacgaggagagatccttgtggttcaactacctgggagctcacaggaccagaagaaggagagtctcccacctagagtgtcttaggtcatttcgtttaacctagagacaggaggtgtcctcagctgggactcaccccctttccccccggccctgagaagtacaggatggacacagccactgtggtctccaagacaccccttcctctaggctgtgacccgccaatccccttctgtctacacatacaatccagctggtcagaagttggctggctaaactgtcacgatagctctcttcccattgatcagtttacctgtcccggtggttatcaacatccatcatgggccagttcgactcttttaattctctaggagcaacctcaagggggcgcctcactggggaagctgcactatcaaccagtacatcctgtacatcatgaccaagcattaaaggagtgggctcaaaaaatgtcggggcttcgggggacagctcagtcgaggagaagtcaggttgggcccatgttccactccatagcagagtaacttcttcccttacagcccagtgtctgcaacaccctaacaattatgctattaatggtctggccttgccaggtctaagcaggtctcacctaggaatttttctctcacctcccaaaggtgatactgtacctgatgccacaatttttcttgcaagaaaacgagttgttcttagattgcctccttttgttgctttaagatcacagttgcgtttgctgagttataaccactcctctggcttgctgagtcctgtctgtgcacccatacaacaggaatgcacacacaatgaagccagtattactgccgatcaagaagtgctcagtttaagcccgaatgtgtggatctgggttggttccgtgaaacattaatttcctaggtgcactcagaattactgaaatgtaacactgtgaagaatggcccacttacgcacagctgcatctaatacagcataagtcatcttacagcaaaatagtcaagggagttttccaccttcatcaccccgtcttttcacatagcgtccagagtcctatataacctttataaccaaagtatcttgggtaacccctgaagtttattgttaatgtgatctgaaaagataaatataggtaatgaccgtctaaatgagcctgacacatgaaaggtggcgtcccaacaaatagctcagtatccaggtattaattaacctgagtctgctccttccgctgagagggagagttttcttaatcagccctagattgatgtttatggttggaggtttccttcaacacgtaccaaataggggttgcagacaacgccagatcccattaaacatctgccatctttggaacataaagtagacaatttgctttcaaagagaaaatcttattctggtagaaaattgcaaattcctttactgtgtatcctttctcatcaagcctgaattcggctttccctcaagttcactgtgatgaaatgcctggagcatctctgtgcctccccgtcttagtattgaactgttagagttacaagacaacagatgttgaaaagaattggtagcttgggaacaactgtggaattttaccatcacatttcagagtaaaagaggtgattaaggcagcccaagttagcacgtaatcctgttagttgcactataattacaagcttcaatgatgggagaaaatgccgcaattactatagtcacattccatgacaagacagatgacataattattattgtggctgtgacacccactgcatttatcctttgcatctgaagtagacagacccacacctatttctaagcaacgctggtctatttaacagtactactgggaatcaaaagcatcttggttggctttgcctgtttctcctactccaagaaaacaaagcaggattacagttaatggtacagccaggttgcagccagcatggtgtaacggtatattttacaaggtctataatggtatatttttacacggtgaaatttggtgcacactccactagaagatatcatatactgcttatcctcagtgggatcctggggacattacaggtatatacctcacctttaaattctcagaaagcactgcagggtgaactcttgtgcttttttttttctcctaacattgggaagtatttgagacccacacaccagttcctaagggcagtctctagatactttcatattatggctttcagaggatcccagtaactacttcgtactattcctggtcagtgtgggcaattcttacttgttggcggatggcctgtgtggggagaggcttccgccctgtgggtgggtcctaggccacaggcaacatcaagcttagagtgggttaggttatacctgaaggtggaaaccagagagaggagggtgggtgatatgtgtgaataaaagaataattcaacagagtccgtctctgaacccttaagtcaaatgtccatagcagcagactagccactgttaactactttcagcataggctttttttccacatcaaaagttgattgcacattgggagctaaatctaagatgcttgaaagagagttgtaatatcaccaaattaacttaagtaagagttgttctgacatggccttcagcacaggaatatcaaagccctcacttgtttagaatatgattgacctagatccaccctggaccttgacttaaccaagcccgttcaacaggtcagtgtttgtcccatctgactgactatctctcagttttgatatttcccaaatttccaaaaagaaatccataattccatcactttgcaagtttgccatgctggataagatggacactccaggcactcagctttgactcctgtaaacgagaacggcaacacctgctggtttgtggctaaatggatgccatcatatattgccgtggtttgaaagtgctgtctcccaaaagcatgttctggaaacaatgcgagcatgttaggaggtgaggcctaatgagaagttattaggtgatgagggctctgttctcatgaatggattaatgctgttatcatgggaatgggctccttataaaaggatgggtttggccccttttttctctctctgcctctctccttgcccttccgccatctgctgtggggtgacactgcaagtagcccctcaccagaggtagccctttcccagcccccagaactatgagttaataaatttctgtgcatcataaattacccagtctgtggtattctgttacagcagcacaagccaactgaaacataagcacatggggttattaatccattattcatttggctactttctagtaggacagagaagatacttgagaaacagacacgaagaagtttctcagaaattattagggcattggatgcccacaatggccctgaccagatcatccccatgaatagaagagatccctttctaagtgcaactttcattttcttcttctactactcatgttctactctttcatttaatccgaagcattttccccttttatctgatcccagttctagaactgctcatcctaataacctttcctcaatatggccagatttttggattttagccattctaataggtgtgtagtggtatcttattgttttaatttgtaattctctagtgacatgatgttgaacatgttttcatacgcttattttccatttgtatgtcatcttttgtgatgtgtctgatcagaaattttgcccttttcttttttcttttgagacggagtctcactctgtcgccaggctgcagtgcagtggcgccatctcggctcactgcaagctccacctcacgggttcaagacattctcctgcctcagcctcccgagtagctgggactacaggcgcctgccaccacggccggctaattttttgtatttttagtagagacggggtttcaccgtgttagccagcatggtctcgatctcctgacctcgtgatccgcccacctcggcctcccaaagtgttgggattacaggtgtgagccaccgcgcccggccattttgcccattttttaatgtggttggttgttttctcattgttgtgttttaagggttctctctctcttgctctcttgcacgcgctcgcgctctctctctctatatatatacattttttttttctagacgagtcttgctctgccacccggctggactgcagtggtgcaacctccacctctggggttcaagtgatctcccacctcagcttcctgagtggctgggattgcaggcacctgccaccatgcctagctaatttttgtatttttagtagagatggggtttcaccatattggccaggctggtttcaaactcctgacctcaggtgatctgcctgcctcagcctcccaacgtgctgggattacaggcgagagccaccgcacttggccctttatatattttggatacaagtcttttatcaggcatgtgtttgacaaatattttctcccagcgtgtggcttgtgttcattcccttaacagtgcttttcactgaagtcttaaattttactgtaatctagcttgtctacttttttctttgatggattgtgcttttgctgttgtatctaaaaactctttgccaaacccaaggtcacttagatttcctatgtcatcttctagaagttctgtagtgtactcttttatatttatgtctataatttattttgagttaatttttataaaatgtaaaaggtctgtgtctagattcattttctgcatgtggatgttcagttgttcttacagtatttgttgaaaagactatctttgcttcatggtattggctttgcacctttgtcaaagatcagctggctatatttacatgggtctattttggggctctctattctgttccactgacctacacgtctactctttcaccaataccacattgtcttaattactgtagttttatagtaagtctttcagtcaggtagtgtcggttctccaactttgttcttctccttcagtattttattggctattctgggtcttttggctttccatataaactttaaaatcattttgtcaatatccacaagataagatttgctgggattttggggtggggcacagcagctcatgcctgtaatcccagcactttgggaggtcgaggcaggtggatcacttgaggtcaggagttcaagaccagcctggccaatatggcgaaaccccatctctactaaaaatacaaaaattagctgctgggcatggtgggcctgtaatcccaactactcaggaggctgaggcaggagagttgcttgaatctgggaggcagaggttgcagagagccaagatggcaccactgcactccagcttgggcaacagagcaaggctctgtctcaagaaaaaaaaaaagaaaaaaaaaaaaagaaaaaaaaaaaagaagaaaatttgctgggattctgattgggatcacattgaatctacagatcaagttgggaaaaactgctattttaactatattgagtcttcttatccatgaacatggactatctctccatttatttagatgtttgattttttcctcagagttttgtagttttcctcatatagatcttgtgcatattgaatatatctgatatatttttgcccatctttttacattcaacctgagtcactttattttaggtctatgtctaatgcaaaatatattctttttaaaggttaaatctgataatctaaattagttttcccacttaacacttattattaagatagatgtatttggtattgtttctgctgtcttattttgtcttttgaaacttttacattctcttttgttttctgttgatgttccatggtctttatttcttgtactccagtaattaagaagtataggccaggcgtgatggctcatgcctgtaatcccagcactttgggaggctgaggtgggcgggtcacttaaggtcaggagtttgagaccagcctggccaacatagtgaaaccccatctctactaaaattacaaaaattagccgggcgtagcggtgcgcacctgtagtcccagctacttgggattgcttgaacccagaggcagaggttgcagtgagcagagatcgccccacggcattccagcctggacaacagagtgaaactgtctcaaaaaaaaaaaaaaaaaaaaaaaaaaaaagcgttttatctttatagccttaatatgtttataatgttaatcaatttcagaaatgaagttatattgattgattcacatctatgaaatatgaggaaattggctatactggacaattatcatgcatgttttcccccagcaactgaaccccttctctggttggaggaatgatctactttatgagtcctcgtgtggggaaacaattatttctcttaatagatctgaaaatgttaaatactcaccttcccagaatcttgcaacttggcacatgtgactttgtttctgtctatctgacacacatgtgccagactttggtgaatgatctgagggaaaagacattaggagcttttgttctggtggcagtggtcctgactagaaggttgagttcctggctcagagtgatagtggtataaactgtagcatgtagtgctgggtggtgattgcagcagttccttcctcagactgttctgcagtgtggttttgagtgctgttcccagaagatgaatcttaagcccacttctctagactttccagcaattttataagctattcaaaatccctttaataaattccttttataatcaacctagatgcttaccaacagtggactggataagaaaatgtagtatatatacaccatgaaatacaatgcagctataaaaatgaatgaaattgtgtcctttgcagcagtatgaatacagctggcggccattatcctaattgaattaatgcaggaacagaaaaccaaatgccacacgttctcatttataactgggagctaaatattgagtacacatggtcacaaagatgggaataggagacaccaggaacgagagacacactacttgaggggtgatggggggaggaaggtaagggctgaaaaactacctgttgggtactatgctgactacctgggggatgaaatcactggtgcaccaaaccctactgacatccaatttacccacttaacaaacttgcacatgtaccccttgaaactaaaattaaagttgaaactaaccaactaactaaattccttttatgtttactcagccagggtaagcttctgttatttgtaataaagactcttggactgacaggttgccatatttatactctcctctcttctccctcccctattttaatgtaagtattttctaggattgtcatagtctactactgacaaatatttatttttacatcatatagatttctgagaagaatgataaaaattacatttttttaagagtggtcatcatagttattattattttttttagacagagtctagctctgttgcccaggctggagtgcagtggcacaatctcagctcactgcaacctctgcctcccgggttcaagcgattcttctgcctcagccccccgagtagctgggaccacaggcgtgtgcctccacgcccggcttattttggtattcttagtagagatggggtttcaccatgttggccaggatggtcttgatctcttgacctgtgatccgcccaccttggcctcccaaaatgctgggattacaggcgtgagccacagcgcccagccagttattcttaattctaagtttacattgattgaataaccctgcaacttctttcctaccatgccatccccgtgtggaagttatttcgattcagtcagctggctggatcccatgttacacacatgtatgtgcagagtccagaggaggcaggagaccactcgggccatggtgctggcaagaatcctgaacaggaaggtcgtctctgagcaagtcagaggctaaagaaagagggtggcagttggcccagcgcagtggcatgcctgtaatcccagcaatttgggaggccgaggtgggcggatcacctgaggtcaggagttcgaaaccagcctggccaacatggtgaaaccccatctctactaaaaatacaaaaattagccgggcatggtggtgatgggcgcctgtaatcccaactactcaggaggctgatgcaggagaatcacttgaacccaggaggaggaggctgcagtgagccgagatcgtgccactgcactctagcctgggcttgtgacagagtgagactctgtttcaaaaaacaaacaaacaagcaacaacaacaaaaaacacaatatggcagtgactagaagatccccaaaggtcctgggaataaagaacaaccacaatgggctggtgcaagctcttcgtcaggctcccaaggtgagagaattgcttgagctcaggagttgagagcagtctggcaaacatagcgagacccccgtctctattaaattttttttcaattagctggacatggtggtatgtgcctacttaggtttgcttaggtttgacagcttctcagggtggaacttttgaaatacgaggcagtagactgcccagtcgttcctatggagttcatcatcagcctcacaggtgacctagtgttctttttggggcagctgctgatgtttgtgcattccatgagctgacacagagggacagaggtcccttttaccatttggtatcttcagtcaatggagtaagaaagttgtctgatacccaaatctgaaggctattaagagtgagaattgagaatctgactctatcacactgataaagaattgagcagaattctaggactgaatattgacccagaaactataacttggcagagagcatttgaatcccagtgatagactttggaggcagatcacctttggagagtggtgactcacactgatgtctccatggtgagtgaaatcgtgagtgttctgtctttcaacagtgctctaaacaggggtctccaaccccctgccagggaccagtaccagtccatggcctgttaggaagcaggctgcacagcaggaggtgagcggccagcgagtgagcattaccgcctgagctccgcctcctgtcagatcagcggaggccttagattcccataggagcgtgaaccctattgtcaactgcgcatgcaaggaatctagcttgcatgctccttatgagaacctaatgcctgatgatctgtcactgtctcccaacacctgtcctgtctagttgcaggaaaacaagcttagggcttccactgattctacattatggtgagtatgtaataataatagcaataaagtgcataataaatgtaatgcttgaatcatccccaaaccgtcccccatgacctgtggaaaaactgtctcccatgaaaccagttcctagtgccaaaaagggtggggaccgctgctctaaaagataggagagactgaggaaaatggcggtgctatctaatgagaacggggatgctaccagtgctgaagatctgggtgtgagtggtgccttgacaagtgctatgaaggatgcatcaagcccagtctcatacagactcagagggaatgctaatattcatctgatggacatgaagccctctagcacagcaggtccaacagcacgaagacttgttggttctgaatgctctatagcgatggaagctggatttggagataactttgtcttgaaagcagtttttttaaagtattattattattattgaaataaagtcttgctctgttgccctggctggagtgcagtggtgagatcataactcaaagcagcctctgtcttctgggctcaagtgatcctcccacctcagcctcctaagtaggcacataccaccatgtccagctaattaaaaaaaaaaaatttagtagagatgtggtctcgctatgtttcccagactggtctcaaactcctgagctcaagcaattctcccaccttggcctcccaaagtgccaggattacagacttgagccactgcacccggcataaaaaaatgtttaattataggactatatgtttatacaaatatatgtgtacatatatacacatatatgtgtatttctataaaacatacatgacatcaaatgcatcgtcttaactatttttaagtatatagttcagtagtattaagtattttcacattcttgtgcaactatcagtaccatccgtctccagaacttgcaaaactgaaactctgtttccattaaacaaccctccattctctccttcccccaggccctggagaacaccattctcctgtctgtttctatgaatttgactcctctaggtacctcatataggtggaacacaatattttgtctttttgtgcctggcttatttctcttagcatagtgtcctcaaggttcattcatgttgtcccacatgtctgagtttccttcctgtttaaggctgaataattttctgttttaagtatacactacattttgtttatccatttatctgttgatagacatttaggtagcttctatgccttggctattgtgaataaactgctattaatatggatgtacagatctctcttcaagaccctacttccaattcttttgagtctattcataggtgatacatggattgtctcacccgatcccatttctataatattgatttgggctctgtggaatcctgataaataagcaacaatgaggaaggggtcccaggttggggagaacaattgttctgagagacggctaaccacaaacaggcccttgcacaacatcctgttccctcactctgcacgtagccccagcagcaggactgtaactgcacgaaccccctccagcatgaccctataaagcttccttccagcccctgcctttttggagacagtcccttttctgctgtgctgcccgttgcttccttgcaacatactttccttctaataaatctgcttttttttttttaaacctatgactgccttggcaaattcctttagcactcatgatccccgctctagtcatcacacctgcaacaggccctgcatcaaaacaggtgactgagctgttccaagtacatcaagcccatccttcagtgccttcaatgcctcctatgactcagattgtgtgtggatccagccatgtgcaagaccctcagcccctgctcgggaagaccttttgactgagcaggcattttctcagctttcttatggtcttaatgtatattatcatgtgtaaattaacataattatgcacatctgtatctcctttagtgaaattcaatggaataaaataaaataagtttgctaaagaaaagcagcacatatttgcattacatttaaacttctgcataattgagaatatatctatgttgccatggacataaatggccacttggttgggtagagaattcattgtagatgctgtttctccttgggctgacatcttcagaactgtggggaagtgttgtccagactgatattttcctcctttgtgggtgaggcactgtagtgtaatgatagtacccaaggttctgggtttgtatccttccttcatcaaatgacaactctggacctcttttctttttctttcctttttttttttctttttttcttctcttttcttcttttcttttctcttttttgagatggagtcttgctctgttgtccaggctggagtgcagtggtgtgatcccggctcactgaaaccttctccgcctaggttcaagcaattctcctgcctcagccacccaagtagctgggactacaggtgctcaccaccaagcccggctaatttttgtatttttagtagagatggagtttcaccatgctggccaggctggtcttaaacttctgacctcttctgatcctcctgccttggcttcccaaagtgctgggacaacaggtgtgagccactgcacctggcctgggcctgttttcttgtctgtgaaatggggtactgatagcaccaacatctcagggctggtgtgaaaattcaagcacctaacacatattaagaatgtaccaaggctgggtgtgggggctcacgcctgtaatcctagcactctgggaggccaaggcgagtggattgtttgagctcaggagttagagaccgcctgggcaacatggcaaaacctagtcttagctatttgggaggctgaagtgggaggatagctcgagccgggaaggcggaagctgcagtgagccaagatcacgacactgcactccagcctgggtgacagagggagaccgtgtctcaaaaaaaaaaaaagaatgtaatcaaagttaggggtatttgtcctaactgactgcttcttctgcctatattcttttttttttgttgttttaagatggaattttgctcttgttgcccaggctggagtgcaatggcacgatcttggctcactagattcctcatgacctctttccttgtttactgaagcagtgtttgaacgcctcccaggttcaagcgattctcccacctcagcctcccgagtagctgggattacaggcgcccaccactacgcccagctcatttttgtattttcagtagacagggttttaccacattggccaggctggtctcgaactcctgacctcaggtgatccgtccgcctcggcctcccaaagtgctgggataacaggtgcgagccactgcgcctggcctcttctgcctatattcttaatgggctctttattattagtattgcttttgttttgctttttgctattgacttatttgttgatggagagatcactctttccttttgagattaagaccctcagctgtatttgtgtctgtgtcgatcatttctctcacactcttttctggaatacggcaagcagtttggacctgcagattcaggtcttcctttatttaatgaagctgttttatgttatatcctgaagagtattttctattccatttattctctctgccaggaatattcgcatacaaatgtgagaatgctcttgtcagtctggatttctatcagcttctaattgcttcggtctgacactccatctgtttcttttgtttcctgtgcaccttcctgaggcctgtctccaggtcatcactgtggctttccacagcatgtgtgccactctccactctttccagtggtgctcccacctccctccaattctttccttagcttttccacctccctttccaactcgttagtttcacctcttcttttttttttttttttttttgagacggagtttcactccgtcactcaggctagagtgcaatggcatgaccttggctcactgcaacctccgcctcccgggttcaagcgattctcctgcctcagcctcccgagtagctgggattacaggtgcccgccatcatgcccagctaatttttgtatctttagtagagacagggtttcactatgttggtcaggctggtctcgaactcctgacctcaggtgatccactccccctctcagcctcccaaagtgctgggattacaggcatgagcaccgcacccagtctaaataaatttttaaaagacagggtctcactctgtcatccaggctcgagtgcagcgccgcaatctcggctctctgcaacctcaacctcccaggtttaggtgatcctcccacatcagcctctagctaggtacatgctaccatatccagctaattatatatatatatgtgtgtgtgtgtgtgtgtatatgtatgtatatatgtgtgtgtgtgtatacatatatatatacacacacacacacacacacacatatatatatacatacctttttttttttttttttttgaagagatagggttttgccatgttgcctaggctggtttcaagctcctgtgctcaggcaaacctcctgccttggcctcccaaagtgctggaattacaggtgtgagtcactgtgctggccttaaaatattctacaatactacaatagaaaattgggtaaacggtaggaatagccaattagcaaaagaagaatttaacatacaaaattagtttaaccccagtaacagtcaatgaaatgtatgttaaaataacgaggcgtcagcaatcaagagatggtatgacataaaggttgagagcgaaggctctggagacacactccctggtttcctatccctgggctctcatcacttttcagctgctgaattttaggcaagttaatgaatcttcatagacctcagtttcctccttcatataacagagtacccacttcattggactgctgtgagaattgaatgaatttaatgtgacttgttcagaacaacgcgtattaagcactcagtaaatgttggccgctattattatcatctgttacatttgcatggcataatgaatggtgtttggggggagaatgtgggaaaacacacacattactgataaaaatataaattggtatccctttctatagggaaatttgatattgactcaaacactttcttgtgtatacagtcatgtgtcgcttaatgacggggatatgttctgagaaatgccttgttagatgatttcatcactgtaagaacatcacagagtgtacttctacaaacctagatggtctatcctattacacaatagggtatagcctatagattacagggtatagcctattgctcctaggctacaaactttttaaatgttaattaattaactaattaattattttgagacagggtctcactctctcatccaggctggagtgcagtggcaggatcagggctcactgcagcctcaactcctgggctcaagcaatcctcctgcctcagcctcccaagtagctgggactacaggtgtgcaccacatccagcttacttttttgaatttttagtagagacaggatctcactatgttgcccagcctggtttcaaactcctgagctcaagtgatcctcctgccttggcctcccaaagtgctaggattacagaaatgtgactgtactgaatactgtaggcaactgtcacacaatggtaagtatctgtgtatctaaacagctaaacagaaaaggtaaggtaaaaatacagtactagatatcttttttttgagatggagtctcgctctgatgtgcagtggcaccatctcggctcactgtaacctctgcctcccgggttcaagcgattctcttgcctcagcctcccaagtagctggaattacaggcgctcgctaccacgcctggctaattttcatattcttagtagagacggggtttcaccatcttggccaggctggtctcaaactcctgacctcaggtgatccacccaccttggcctcacaaagtgctgggattacaggcatgagccaccgtgctcttttttttttttctttttttttttgagacagagtctagctctgtcgcccaggctggagtgaggtggtatgttctcagctcactgcaacctctgcctcctgggttcaagcaattctcatgcctcagccccctgagaagctgggactacaggtgcgccaccatgcccagctaatttttgtacgtttagtagagacagggtttcgccatgtttcccaggctggtcttgaactcctgacctcaagtgatctacccacctcggcctcccaaagtgctgggattacaggcgtgagccaccatgccgggtcaaaaaatatacactactagaatcttatgggaccaccgtcatatatgcagtctgtcgctgactaaaacagtttttatgtagtgcctgacagtatatatctctcttttggccaagagattttcagtccttaggaatttatcttaaagaaataatcagacatgaaaattttatctaccagtatgcttgctgcagtgcttccttaaaagtaggactcacaacacatgcacatgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctgagcaaactatcgcaaggacagaaaaccaaacgccgcatgttctcactcataggtgggaattgaacaatatcgcttgggcacaggatagggaacatcacacaccggggcctgtcaaggggtggggggaggggggagggatagcattaggagaaatgcctaatgtaaatgacgagttaatgggtgcagcacaccaaatatggcacacgtatacatatgtaacaaacctgcatgttgtgtacatgtaccctagaacttaaagtatgataaaaaaaaaaataggactcacggcccggtgcggtagctcacacctgtaatcccaacactttgggaggccgaggtgggcggatcacgaagtcaggagatcgagaccatcctgggtaacacagtgaaaccccgtctctactaaaaatacaaaaaattagccgggtgtggtggcgggcgcctgtagtcccagctactcaggaggccgaggcaggagaatcacttgaacccgagaggcggaggttgcagtgagccgagatcgtgccactgcactccagcctgggtgacagagtgagattccatctcaaaaaaaaggaaaaataaaaaaagactcacaattggaaataactgaaatgtctaaggataggagactggttaattattgtacatcgggggaaaatagatattaaaaatgacattttaggagaatatttcctgaccttgttatatgatcacaatatactgttcagtgatatatcaggttataaaaaagcaataagtgtacattatggccccagttttataataaatgtaaaacaaatatagatggaaaaacatcaaaaggtagtggttatagaccattccaattatcctctttatacttgtcagcatttttcaaaaattttaaaaataaacaagtacctaatctcagcactttgagaggccaagatgggaggataacttgaggtcaggagttcaagcctagcctggacaacatggtgaaaccccgtctctactagaaatacaaaaattgtccaggcatggtggcacaggcttgtaattccagctactcgggaggctgaggcaggagaatcgcttgaacccaggaggcagagattgcagtgagccaaggtcacgccactgcactccagcctgggcaacagagagagactccatctcaaaaaacagcaacaacaaaaaagcaagtaccattttaatgaacagagaagtagtatcattttcaaaacaagcattaaaggcccctgaaaaggatatgactttttcacattctcacttcaacccaccagatgttctgcttctttgttggaagcgctttaagtaagctccatgcttaggtatgtgttcgagccactctcatttatttatggttttaaataaattatcaacggaataaagagagtatatacgagaaatatctcaaagacttgtaaattcaacttttgtgtccttgcatttcctatttttttgattatttgttctcctttcttttaagcaccaaattatacccttttaaaaaatagctctttctctttttctgttttctctacatttttcttagtttttatgaaggaagattgttaataactgccagtatctgtcacgacacaatcctttctttcttttcttttttgagatggagtctcccgctgttgcccaggttggaatgcagtggcgcaatctcagctcactgcaacctccacctcctgggttccagtgattctcctgcctcagcctcccgagtagctgggattacaggcacacaccaccacacccagctaatttttgtatttttagtagagatgggatttcaccacgttggccaggctagtctcgaactcctgacctcgaatgatccacccacctcggactcccaaagtggtggagttacaggcatgagccactgcgcctcgccacaatctcttttctttgatgtcagtatctttctgcactatcgcactctaaatacagagggtccctgacgtacgatggtctggctgaatgattttttcgaatttacagtggcagaaagcaatacgcattcagtatgctcctccacttcccatggggtcacatccgcataaacccatcgtaagttgaaaatgtcgtaagttgaactttcaatttataataggtttattgagaggtagccccattgtaagtcaagggccatgtgtagccagttctcctgcgtttcttgggcttcaacttttagtgcatccatcacctgaaattcctctcttcctgcactcatgttttcagtagtctatagaacgcaggcccaacaatatattgatctgtcaatactcagcaaataaagcctgtgctcacaaaattaatctcagcctaagggcagcccttgtaggaattgtgagcacacccaccccacggatgttgaaattatctcccaggacaaatgagactgggcagaatgttccttggccagttttccttggccattccatcagttgcttctagtccctggctgagagttgggcttgctcaagggtgtctgtccaccccagagcctcatgagccacagacataggattgacccaatgtcagcaatttccctttcctgtggggcaggagaatcagggcaccctgagggatggcacgtggaaggcagcgtggaacccgcctgagagcctgtgtcctgactctgcctgggagcgctgcacttcacccttgggagaacgccttctcagtggctgaactctgcattgtggctgtgcaggctggcttcagacactgttttctccagtgaggcctcttacactctgctcagctcagacctgccataaccgcttgtcggattttctctatttaatgatcaatgtcatatatgtactttttttttttttttttttgagacagagtctcactctgttgccaggctggagtgcagtggcgtgatctgggctcactgaaacctccgcgtcccggattcaagcgattcccttgcctcagcctcccaagtagctgggactacaggcgcgtgccaccatgccgggctaattttttttttgtattttagtagggaggggtttcaccatgttggccaggctggtctcgatctcctgaccttgagatctgcctgcctctgcctcctaaagtgctgggattataggcgtgagccaccgcgcccaaccatatatgtacttttctaatagagttttagattgtttgaacttctgatgggtgagaaaaagaataaggctatgatggtattctttcccttagaacccatatagtttccaaaattcatctttcatgtgctctttatttcttttttagaaacctgggtattattttccaagctttgtgctttttgtgaggctatacaggttctatggtgaatcctcctcatgcctgcgacaacctggaggacattacttgtttttagctgctgataagagtttgcaaagaacacacatctttgttgggaaatgctttgatgtgcttctaggcaagatgaagagtcacatggagtgggggtggtaatttgggagaagggccaagtagcaggggattctcgataaatattaaatgaatggaggtaggaaggaggtctctgaaccacactgtgtgtgggtttaagatcttgctgtgggctttgtggtgtaatgcctcaatctatatcccctactgaagtctatatttgcacttgtgcttttgtgcaaatggggacaagcagaacttcaagacaataatgaatatttcagctacgtttttcctccatgaatcgtgcaaagctctctgaattggcactattactctttcttacttctgcaaccccagaactgcttaatgcagttatattttcctttctcttcccagtgacagatgtccccttattttcctgggcggcaaatgccttcttttccttccttcctccttagaaactctcctgagcacaataagctacagagcctggtggtgggccctatggttggctacataccatgccatcccgggggctcccttttggtttcctgctggtacctgccctcgcctgggatgtcctctttgggttcccatctgccgtgctctcacctggaagccagctctgtgggcctgggagttgccacgattcctaccatggaccctccagctggttcccatgcagcctgccctatcgtcgtgtgcacattcacctgctaggcattctcactatgcagtcagtatgggcctggccttttcctcttccttggaaaatccatctcagtgttttctttttttttctttttaggtagagtcttgctctgtcacccaggctggagtgcaatggtgcaatctcagctcactgcaacctccgcctcctgggttcgagtgattctcctgcctcagcctcccaagtagctgcggctacaggcacgtgccaccacgcccggctaagttttctatttttagtacagatggggtttcactatgttggtcaggctggtctcaaactcctgaactcgtgatccacccgccctggcctcccaaagtgctgggattacaggcttgagccactgcgcccggcccatctcagtgttgtcatctggccctggtgtttctgacatggtgtgtgcgagttcagtggattctaaaaactgctcctctcctccttccccagggctgccctctgtcatttcctatccagcctccctctttccttcctcctctctggcagtaacctcgtacccatcccagaaaggccattgcctttccctggtgacttcctctctcttccctcctcaaggtccttgacgaggtcatcgggagtgtccttgacagctcccctttctttccacattcgtatagtctggctgataccaagatgcaccttttctttttttttctttcaagtcttgcatcacatagatttttctgcaaagccacactgtgccctgaaaccagggatgcctagggctgaaaaccatgtgtgagcttcatactcattagggtgactattattaaaaaaacagacatcactagatcatcagggaaatacaaatgaaagctacagcaagatatcacatcaaacctgttaggatggcaattatcaaaaatacacaagatgacaagtgttgctgagtttggagaaaagggaaccgtggtatgccattggtgggaattaaatttagtacagccattttggaaaactgtggatgtttttcaaaaattaaaaatagaactaccataggatccagcaatcccactactaggtatataacccgaggagacgaaatcagtatgtcaaagaaagatctgtgtttctgtgttcattgcagcattagtcaaaatagccaagttatggaatcaacctaagtgtctatcagcgaatgaatggataaagcaaatgtggtatatttacacaatagaatactactgagccctaaaaaagaaggaaatcttattacttgagaaaatatgggtaaccctgaaggatattatattaaatgaaataagccatgcactggacaaatactgcatgatctcacttatatgtggagtgtaaaaaagtcaaatttatagaaatagagagtaaaatggtggctacctgaggctgtggggtggtgagattagagagatgttggtcaaaggacacaaagtttcagggctggctgcggtggcttaggcctgtaatcccagcactttgggaggccaaggcaggcggatcacctgagaccaggagtttgagaccagcctggccaacatggcgaaccccgtctctactaataatacaaaaattagctggacgcggtggtgcacacttgtaatcccagctacttgggaggctgaggcagaagaattgcttgaacccgcgaggcaggggttgcagtgagccgagatcatgccactgcactccagcctgggtgacagagcaagactccatctcaaaaaaaaaaaaaaaaaattcagttagaagaaataaattcgagaggtttattgcacatcatggtgactacaattaataacaatgtattgtatacttgaaaattgctaagagaataggttttaagtgttctcaccacagaaaactaagtatgtgagagaatacatacattaaatggcttgacttagccattccacaatgtatgcctatgtcaaaacttcatgttgtacaccataaatatacaccatccccctcagtactgtcgtcatgatagtgagtgactttaatttttacttgtcaaagtaaatacattaataaaaaaaaaaaagtaaatacattaataaaaaaaaacccagaaaacaagtgctggtcaggatgtggagaaacgggaattcctgtgcactgctggtgatgacgtgacgtgatgaagcccctgtgtaagcagcgtgacagttcctccaaaggctgaacataaggccgggcatggtggctcaggcctgtaatcccagcacttagagaggccgagacaggcagattacctgaggtcaggagttcgagaccagcctggccaacatatagtaaaaccctgtctctactaaaaacaaaaattagctgggtgtagtggctcatgcctgtgatcccagctacttgggaagctgaggcaggaaaaccacttgaactcaggaggcagaggttgcagtgagctgagatcatgccactgcactccagcccaggcaacagagtgagactccatctctcaaaaaaaaaaaggtaaaaaggttgaacatagagttaccctatgatccagcaattccacttgtgggtacccaaaggaaccaaagtaaagactccaacagatacctgcacacccatgttcctaacagcattatttacaatagtccaaaggtggagataacccaggtgtccatcaatggatgaatggataacaaaatgtggtctatccatgcaatggaatacaactcagccctgaaaaggaatgatgttctgatacaggctacaacatagatggatcttaaggacgataagttaagtgaaataagacaggaacaaaaagataaatactgtatgatcccacttatatgagatacctagtgtagtcagattcacagaggaaaaaggtagaacggtggtcaccaggcatgggcagggcgaatggggagttggcactgaatgggtacagagtttctgtgtgggaagatgagaaagttctggaggtggatgctggtgatggttgcacaatattgtgaatgtacctaatactgatgaattgtacatttaaaaatggttaaaatgataaattgtatgttatatatattttaccacaactaaaaaaattaatgttcaagggtgtccaagcaagaaaaaaacaaaaaccacccatgtgtgctcacgcatctttggcacagatgcggttcctaggttcagctctctcctcaggcattgtctcttcaatgacaacattctgtttccaccaactctgtttctgaaccaaatctgacacagctgtcactggcctactccctggaattaccacaggatctgaattagcctctggcaggccccctgaggaatcttgctttcacgtttccattatggtcagcacagcaacatggcggcctatcccgttttttgtttttttttttttttttttcctgagatggggtcttcctctgttgcccaggctgaagtgcagtggcacaatcttggctcactgcaaactccacctcctgggtttaagtgattcttctgccttagcctcccaagtagctgggattacaggcacacgtcaccagacccagctaatttttgtattttttagtagagatgggttttcaccatgttggctaggctagtctcgaactcctgacctcaggtgattcacctgcctcggccttccaaagtgctgggattacaggcgtcagccaccacatctggcctgcctatccctttgattgaatatcacctgagtaactgatatggtttggatctgtgtctctgcccaaatctcacgtcaaattgtaatccccagtgttgaaggtggggcctggtgggaagtgattggacatgggggtggtttctcatgaagggtttaaaaccatctcccttggtactgttgttgtaatagtgagtgagttctcaagagatctggttgtttaaaagtgtgtagcaccttgggaggccgaggcaggcggatcacgaggtcaagagattgagaccatcctcaccaacacggtgaaaccccgtctctactaaaaatacaaaaaattagccgggcgtggtggtgggcgcctgtagtcccagctactcgggaggctgaggcagaagaatggcgtgaacccgggaggcggagcttgcagtgagccgagatcacacctgggcgacagagcgagactccgtctcaaaaaagaaaaaaaaaaaaggtgtgtatcgcctcccccttctctctctttctcctgctatgtaagatgtgcctgcttacccttcaccttctgccatgattttcaatttcctgaggcctccgcaccctccgccctgagaagccaagcagatacaggcatcatgcttgctggaccacctgtggaaccacaggccaattaaatctctttataaatgacccagtcccagggatttctttacagcaatgtgagaatgaactcctacagtaactcatttgtctttgactttcctctttcttttagtgacagtgtgtgtgcctaagtgactcttgaagaagccttcattcttgaagacacccggtcctcacaggggctcctggggcggtgtctgtggcaggtgaagatgctattgcagaatttatcttccttgccagaagagaacgcctgggcaaaggagaactgccttatagcccaaactggggcccactgtcttttcaggtctctggccatggggcttgacagctggattctaacgtctctctccctagtgcctcccacgtttactctccatgttctgttgattttcttggtgtgtttgcctccccgatcgcatctttgctgtctgctccacactgtacccgatttctgcccctccttgcctctcttgattactcagagcttcaactacctcctcacctctgacaactccgtctattgcttacaggttggttcacctcacacacctgtcacctcatggctgtggcttccgcacctgtgtgcatggcgccctcctcccatagctctcttcccagcacaacctgcagctcctcccgctgcccagctgctccacacgagccgtgattagctcacaccggcctttcctcctccactatcagctcagagccagccatagctcacaactctgagaagtcttccctgagccatacggaggagactgtcgccttcacatttctctcccaggacccttcaagtatagattaggtgctcagcaatgcctttcactgcagtcctcatcctttttcctgtctgcacttctggagcacgggatgcctgcagctttcatttgaaacccctttctatgctattgggacccgctgtgtcttagaattgttttctgggttctaaacttgctccctcctctagtctagagaccaaggactgacatgtaatttgcagttggtatcggtatgtatgagatgtagatgctctagtaacatgggtccggtgatactgacttacatcacgctggattccttccttgcttcatataccctcatgtaactttccgtgcatattttctgcctccttggagaggttgtacccccagagctccaggggaaaagaataactgtccacacagaggtgagtattggtgctttctagccatacactagcatgaggggaggggtcagggaggctctgtccatagaaggcttcaggagtcgcccgttgccatggattctgtgttttttgaatcccagatgcccaggtgagacctctgatttgtgttccccaagaccacagacacatggagcttcctggcatcaggttcccgacaccagagttggggttcctttcaactctattacagtcaacgagcgtcatgctcacggactcgttcagagccacatgctttgcctggccttctgctcacctctgagtggcatctggagaagaggtggcttcatcttgctgcagtcctcccagcgtggagagacctgcactcatcagtgaaatgaatacaacgggaggtgtctggaacctttcttcattttcaccaaaggaatatttgacacacccaggcatggttcagagctccaccctcaacaataatcctgtcaaaatatccgatgttgttgaacctcaaaggcactgtatcacagcagaaaagtgattgatctcattgctaaactctctttcttgcttattggcatgacaacggagctaaatagagccgagatgaattatgagtctatttttggagactccttatggaattcatgcacactgtgtattttgcatcctttgaatccttgggcacacttagaactgtgaagcaaacactcatttgtaaatgttacagctgccaaggttggctgcatgctctgctgggtgacgtgttaactctcacaagtctgctttggaagcaggaggaatgttttgagctgagcttcgggcggagggtggggctgacgcatgcatgcttaccttgaccctgtccatacaggcttccatctttagctgctccacagctttcctggcttgggagatgctagtggtgctgttattagacatgccctctttcattctactgcccctagaagtaaccaaagtaaaagggttagaagagctgctcttccaagggtaggggaaccccacctcccaccacctacagcttctctgtccaagccagggagcatctgggagcatggacagcatttggtagaaaaccctcctgggataagagaaaggaatgcctcattcgagtaagaggagcaagacatgatgcttttgtttggaaaaactttctcagtcccggggacagtgagaagagaacagaaggttccagaatgacttttccatcacccccaccactgccaccaccatcaccaccacgaccataagtaatgcttggacattcgtatagtgctttgagtcatcattcactttcacacacgtttgctcattcattgctctagcagcccatacagttggtgggacaatattaatttctattttgcaaaggaagaaagtgcaaaaatcagagaaattaaaccaatagccaaagatcctacagccaacatttgtggatccagaactcaaactcaaagctttgaagcctagccgagtgtctcaaatggcctctcctaacaatctatggctcataacacacatttctaatgaataaaattgctttattaattttaatttgttgtccttccaaaaagtttacagactttgtgttgagagtttgttttcaacaataaacacacgcacaaacacacactctctctctctttcttccctatcccaagcatagatttattttctagagggaggcagaagaaattctccctaaccctacacacattgatgccccgtgactaagaccagtgtagtgctacctgtttcacagaaagcatgtgctacacacatcacaattgcaattgccccgtctaatgagaatctgcttcaaaggaagcctaaaactaaagcctgagagctggggacaggtcactgagagcagaaacacaagtgacactggctcccaaaggtacagatgaggtgggaagaggccctggccaccatctattattcgtctgcttctgtttatattttatttcagttttaggtttttttcccacctcacaactgttggactttattgtattaatttaattgagtatgtaaagcagcaaccatactttcaaagttaaaatgatgcaaattgatattcacacaggtgtcactttcactgcccattccaatccttttctcccctcccacctacctcctatgggcaaccaatcacactggactccagtctattctttcctatgcttcttttttctccttccttccttccctccctccttcccttcctccctccctctggtcttccttccttcccatcacgttggactccagactattctttcctatgcttctttttccttttcctttcctttcctttccttccccttcccttcttccttccttccttctttttgagatagggtctctgtcatccaagctgtaatgcagtggtgcaatcacagctcactgcagcctcaaactcctgggctcaagcgatcctcctgcctcagcctcctgagtagctgagactacaggtgtgtgccgccatgcctggctaattaaaaaatttttttttgctatgtttcccaggctggtcctgtgtttattttcttagaaagtaagcagttacatatatgttttctcatttctccttctttcttacacaaaaagataacgtgtgtgtgcttttgaactttgtttttatatttagcaatacattttagaaagcaccacatattagttcactgatatgcaaaaaagatcatactcattctttcttagaactacatactacagtactccactgtgtggatatactgtatatttttcaatccatatatttacgggcatttacatctatattctcatattattgtgggggtgtgtcttcaaggtacatttctggaattactgggtcaaaggtaaatgcatatttacttttgtgatatattaccaaattctataaggtaacattctgataatttttgcatcaagattcttaagtaattttggaattcagtactattcttaagtaataaattaagtcatttaatgctaccttcatctggtttaaatatcaatgttatacttgcttcatacaaaacatttagaatttttaagaaattttctatttggccagtaggttagtgtatgggacccactctctctgtgggttttaatcacatatgaactaattctctggcccagaaaggcataatggcaactacatttgtccaaaggcagtttttgaaaagtaaaatattctcgttagaagacagatcagccacccaaatcagagtttaatagatgtgtgtccttatcttagtttggaactttaactcaacaacaagggaaggagaatcacgacaagttgggagctttgaaatccaaggaacatccccttcatcccccactcagcagaactgtgcacgcgttcctgcacatgtgttggtgtgtccttgggtgtgtctgtatgtgcccacgtgcctgctcgtgcaggccttgtgccagtctgtgtgtggccatctctccgtgtgtgtgtgtgtgctgatgtgtgtctgcgttgctgtgtgtctacacaaaatgagggaggagacacagtctagttcccaacccttcccagctgatgcaatgaaaaaaggactctgatgtgatttggatgtttgttccctccaaatctcatgacgaaatgcgattcccaatgtgggaggtgggtcctggtgggaggtactggatcacggggccagatcagtcaggaagggctcagcgccaccctttggtgataagtgaaagtcactctgagttcatccaagacctggttgtttaaaagtgtgtgtcgccttcctgctgtctctcttgctcccactcttgctgtgtgatagtatggctcccccttcaccttctgcatgagtggaagcttcctgaggcctcaccaggaacagatgctggctgccatgcttcctgtaccacctgcaggaccataagccaattaaacctctttcctttagaaattacccagtatcaagtattcctttacagcaacacaaaacagcctactacagaccctacagtgactgccttcaaatcttgatcctgctctccccattctagactccatccctctcgccccttgtctttgacttgggcatttaggagttgggggaggttcaggggaggaggaggtagagtttgggatcagcaggggtgaagccaagaggacatggagcagggcaaagggaggaggggagggctctgcactgtgtgtgagggagtctgtggtgagtaggagtgtgtgaaagtgtggggtgggggtgagcgtgtgagagtgtgtgggggtgagtgtgtgtgacagaaagtatgtgtgagggtgtgggtgagtgtgagtgtgtgaggtggggtgtgtgtgatgacagtgtatgtgagtgtgtgtgaaggtgtgggttggggtgtgtgtgagggtgaggggtgtgtgtgtgtgagagtgtgagagcatgtatgagggtcaggggtggggtgtgtgtgagtgtgtgtgtgagcacgtgtgtgagcatgtatgagggtgaggggtgggggtgtgtgtgtgagggtgggtgagcgtgtgtgagggtacagggtggggggtgagtgtgagagtgtggatggggggtgggggtgtgtgaatgtgaggtgggtgtgttgtgggtgtgtgtcagggtgtgggttggggttgtgaatgtgggagggtgtggggtggcggtgagtgtgagtgtgggagggcatggggtggggtgtgtgaatgtggggtggagtgtgagtgtgggagggtgttgggtgtgtgtgtgactgtggggtatgtgtgcgagtgttgggtgtctgtgtgtgagggtgtgtgtgggtgtgggtcagggttcagggtgggggtgagggtgagtgtgggagagtgtggggtgggggtgtgtgtgtgtgtgaaggtgagagtgtgaatacaggcacgtctcagagcatgcggggtgaacgtgtgtgtaagtgtatggagtgtgtgagagggtgtggggggtgtgtttgtgtctggagtgtgagtgtgtgggtataagtgtgagtccttgaggatgtgtgcacatgtgcacaggtgggtcatgtggcggggagggaacagctaacgttaccggggaaagcagcagagccgactctcagtcccgtcaggcccctgcagctgcgcccacctctctccctcccaggcgctgttcagacggccctgatccctcagcccttcctcattcttccgctgttcaaaagaagggctcgttttccacatgccctaccctctccgcagaggagagttctggctggaggcttcctgtgggaaggtcccaccagcgcactgtgctttccttgttgtgcgctggagataaaataagcgggtgggtgaccctctgggggttccatccctccatggcctccctctcaggccctccatgtgcgtccactctccagcccatgtctgccacccacagccgaggcccctggacctggcccccagcgggggctgtgctctccgaccccagcttctccctcagccccttctctgctgcttcctcctcccctggctccatacttagcctcaacagcatgacccaactaccaccactgtctcccaagagccgtctgcttctctggccctttcctctgtccctaaaacctgcttcggtatggacccaactcctcccctctccacactcacgaaggggctgctcagcgctgctggagagaccccccccactaaactctgcccatcagacatccacaatccagcctctgcgaggccctcagagctacctggcaataggactccttgccccaaatcatctccccctcccttcatcctcttcttccagtcttcatcacttcctcatcacctctgacctttcctcctcagcagaggacctcagcccctctgtctacacagaatggccattagcagagaaccctccttaatgttccccaccccacctactccactccacacccacatccatccttgcctccactcagggcagcagctcttcctccacagcagagcctgtaggacaccacccacagctgctcccgacttgctgccctgccggcagggccctccttcctccccaggggctgacaatggcagactcactttcttgcctcccttgctgtaaggccagagcacgcgtgtcaggaacatggctgtgctttggtcaaggataggctgaggtaaacatccagagtgactcagcaagtttagagcgcaggcgtataactccacttgtcatcacagccatatagccataacatcggaaggctcatcatttggctctaagccactgttgtttgtaaaagctattattgccctgctgacactgtacaggcatgctggcgcccagagaaagagccaaagctgtccattttgcaggtagacagggggagccagggcacagcacagttcagctcgtgcccagagagagaaagagttaagctgctgaccccgaaggcaggggagagtcggccatgcagctatgtgtgggagctggctgctgagaggagccacaaagccagagcagacagctgagtcaaggcggacagtgtgagagagctggtatgagtcagctgctgagagacctgttgagtaaaactacatttcacctgcttatggccccacgagtgttccttcagctacctgcccatccgcccactcccctcgaacctcagcatgggctggaacctgaccccaagcagggcatttggtatagttgtgaacctgacaacgtgaccttgtcctcctcaatgggacatcaggggaaatctgcagggactcatagggagggttttcctccccgacggagggacaaggggagaaagctctgtctttggccaccttgagttgtgtttgcagctgccagagccataaaaccactggggaatcaaccaaggacacggtcactagtctagtggagaaaatgacctggatccttgagctgggtgggtccttggaagtctattcctgatccttgaaatgagataatgtactcctcatggttcaggccatatttgttgggtcatctgtcacttgcagctgaaggcatcttctcagccaaggctaacacttcacaggtcagtagaccgctcccctccccaagggatctgccctacactcacccctccatcctgtaatgtccacgtctctggcgcttttcctcctcagaatatgcaaatatatttatgcaatctgcacctgaccatcttaaaacaagcaacaacatcaacagtcttccctccctgcaatcttctgcattcttgcttaagaaggtggagaggctgggtgtggtggctcatgcctgtaattccagcactttgggaggccgaggtgggtggatcacctgaggttaggagtttgagaccagcctgaccaatatggtgaaatcccctctttactaaaaatacaaaaattagccaggcatggtggtgggtgcctgtagtcccagctacttgggaggctgagacaggagaattgcttgaacctggaaggcagagattgcagtgagccgagattgcgccactgcactccagcctgggtgacagagtgagactgtctggaaaaaaaaagaaggtggagaggtaaccacagattcccctgagaggcccctcagtaactaaaggaagagattctaatgtaaggatgaaaagccgtctttcgggagcactgggtaaacaggcctgctccacggtctctgctctgctgccctcggctcaccctgattctgtgtctaggacagtcacccttgttgcccagagtgatccttaagcgatttcatgtgtgcgtgtttgtgttttctctctccaaggggctgctctggcttctcccagcactgtggccctgcacacctggacgtccgtattttacaatctcccaggctgattctggcccgtaccaaaggagagcaccactgctggctgtgagccacttctacttcgtgattccttagtgtccaaattaccttgcatgggacgcataggatgtctcatgtaccttaggggctgtctcaactagtcctttttgaattttaacgtgcatatgaatcacctgaggattttaaaatgcagattttgatcgagtggctctggggtaggggccgagatcctgcgcttctaacgagcttcgtgaggctgctggtccacggaccacactttgagtagcaaggctctgaatcactgactgttggtattgcaggggaacatggaggtccggttccaatcctcttatttttcagataaggaaatatattcaaggaggttaggtaacataatttcccagcgctcctcagcaggagtggaaggaagcactgctccgccactgctcctggctcattacccaccttggcctagtggcgcttaggatttcatcccccacacttggtctgtcctgctctcctggaacagactcatcccctgggtgatcctaaccttgcttaacctgggagtgaggtgtcaggagggagccccttccctgaggtgggcaaaaaaagcaggaaatccctggtgggggagaaggtaatggcttttgccaatggtgctgaagacaaccacatgctttgaagatagagccctataagaaggtttcggaggtcctgcttcccctacctggccaggtaccctttaggctccacctgaataacgcccctgcctttctgagactgtctggatgctatatgtacttccatggggactcaggtatgcctccctgcacagacattcatgcgtctgcacatcccacctggacccaagaagaaaaatggaagtaggaacagagaggagctgcaacaaatctccacacgcacactggctaccggcaacactgactgggctctcggctttccagaagatgaggcaagggggaaaagggaccatttgcttaggggtggcacctggggccacgtgctcacacagctctttcttcccaggtatacaggaatgtgctcatgcacataggtcgcaccgggggtttcttgagatgcagcagagaacccgttgtacgggtctgtgggacccccagcagggaaataaaggaaaatcttgagttccttcaagggaaattccaagctagcaccaagttagccctgagaagtaaataagtgacttgataagcaagaaggtaatagtagcttaaaacaatagccaaggaagctagaattacgagatgtttggtttccctatagaaactaaagataacatcttaacatatgtctctgagttgtttttcagaaacccggccccctacggaatgaatcagctggcacagagacctcagatgagggggaactgaggactcaactctgactgctgcttttggttctaaatttcttcctgggccgggtacagtgactcacacttgtaatcccagcactttgggaggccgaggcaggtggatcacttgagatcaggagttcgaggccagcctggccaacatggtgaaaccccgtctttactaaaaatacaaaaaagattagccaggcatggtggcacgtgcctgtaatcccagctactcaggaagctgaggcaggagaattgcttgaacctgtgaggcacaggttgcagtgagccaagatcacaccactgcactccagcctgggtgacagaatgagactcttatctctaaataaataaataaatttcttcctgagggtcctggagggagtcctgcccacaagccagagctaacattttttttgccgaccccaacattttaaacaaagcttcttttccttaagtgattgcaaatcagaagatctttaaatccatccacgacctgtaacccctggcttgaagatagccgcccttttcggtcaaaaccactgtgcaaccgccatgtgtcgattttacaatcttacctgtaacttctttcctgaaatgtacctccgactttaaaaacccttacctgcaagctactggtcaggatttgagcatgagccgccgggtcctccttgcttggtgcccagcaattaaacaccctcctttcttccactgcaacacctcggtgtggatatctggtcttaccacgctgggcaagcagaccccggtttgctctgtaacattttttttttttttttttgagatggagtcttgctcttttacccaggcttggagtgcagtggtgcaatctctgctcactgcaacatccacctcccaggttcaagcaattcttctgcctcagcctcctgagtagttgggattacaggtgcgtaccactatgcccagctaatttttgtatttttagtagagatggggtttcaccatgttggccaggctgatcttgaactcctgacctcaggtcatccacccgtcttggcctcccaaattgctggaattcaggcatgagtgcctgcatccgaccatgctctgtaaaattctgatgggctgcatcttgcagcacacaactcagtaaatacaaagttggggctgggagaccaatgcaaggcggttccatccccagtgcttctgacctgacctgactcacggcacagtacttagaatttctggaagccaaatgtcattgtgcctttgcagccatcctccccaactacgacttctgtccatgagcacttgacaagtatctgtaggcagaatactacagccggccttccggacaatgcccaaaagacagctgggtccggaattggtgggttcttggtctcaccaacttcaagaatgaagctgcggacccgcgccgtgagtgttacaattctcaattcttaaaggcggcgtgtccggagtttgctactgctgatgttcggatatgtttggagtttcttacttctggtgggttcatggtctcgctggctcaggagtgaagctgcagagcttcacggtgagtgttacagctcttaaggcggcgcgtctggagttgttccttcctcccagtgggtttgtggtctcgctggcttcaggagtgaagccgcagaccttcgtggtgagtgttacagctcataaaggcagtgggggcccagagtgagcagcagcagaatttgttgcaaagagcaaaagaacaaagcctgcacagcgtgcatggggacccaagcagattaccccagctggcgcgggcagcctgcttttattctctaatctggccccacctacatcctgctgaatggtccattttacagagagctgattggtctgttttacagagagctgattggtccgttttgacagggtgctgattggtgcgtttacaatccctgagctagacacaaaagttctccacgtccccactagattagctagatacagagtgtccacacaaaggttctccaagtccccaccagcgtagctagatacagagtgtcgattgatgcattcacaaaccctgcaaaccctgagctagacacagggtgctgattggtgtgcttacaaaccttgagctagatacagagtgccgattggtgtatttacaatcccttagctagacataaagtttctccaagtccccaccagactcaggagcccagctggcttcacctagtggatcccatctggggccacaggtggagctgcctgccagtcccatgccatgcgcccacactcctcagcccttgggtggtccatgggactgggtgccatggagcagggggcggtgattgtccaggaggctcaggccgtgcaggagcccatggtggtggggaggctcaggcatggtgggctgcaggtcccgagccctgccccgcagggaggcagctaaggcctggtgagaagttgagcacagcagctgctggcccaggtgctaagcccctcactgcccggggcttgcgggccggccgctcccagtgcggggccgctaaacccacgcccacccagaactcacgctggtccgcaagcaccgtgcgcagccccagttcccgcccgtgcctctccctccacacctccctgcaagctgagggagccagctcccgccttggccagcccaggaaggggctcccacagtgcagcagagggctgaagggctcctcaagtgctgccaaagtgggagcccaggcagaggaggcgccgagagcgagcaagggctgtgagggttgccagcacgctgtcacctctcacagctatccctgagcctgaagggacccagcagcttaaactgcgagtggggaggaagtgagtggtggacctcctttcatccttgctgaacaaggaagctcactgcaatagcatctcttttcccacagggaagcacacagcacggttccccagccaaggcccagcagccctcggggatggctcagttctcctcccctgctcccccaacaggtgcacatccattcacataggggataacaggaggtggcaaaaggtttctaagggccccgtgtctgccgtggagggtgggagaaggggacaggacagtgatgattgctagaagaaagtgatgctgtgaggacctggccaccatcaaggatcctgagaactgagtctcaccccagcccacacacatgctcctggcgaagacacctgctgtcctcctgcccctacacagggtaagtcactctccttacctgctgagaggcagccgtgtgacaggcctgggcaagggacagaggctggcggtggcagcagctgtcagtcgtcagatgagaggtgaattcagagcttctgctttgaggtcacctgaaagcacaaccagagacatgtctagaggtgtggggactccctggcattgctcccagagtccccatccaccctgtcccatggttcccctctcctcaaactcagcagccttccccaaaagcctggggactccatatcagaccttggggagatggggagctcgaggcagacagagaaccctcagatctgacccagagcagactggaaacacaacttcagggccacaggccaccccgggcctcaccagactgctcccctggaccctgcaaaccttcatgcccagtcgctctgccccccaacacaaggagccccagctccagccaaacctatgccaaatggaaacaggtcacgtgttttcttcttataaaaatatacacttggggccgggcgcggtggctcatgcctgtaatcccagcactttgggaggccgaggcgggcggatcacgaggtcaggagatcgagaccatcttggctaactgggtgaaaccccgtctccactaaaaatacaaaaaattagccaggcgtgatggtgggcgcctgtagtcccagctacctgggaggctgaggcaggagaatagtgtgaacccgggaggcggagcttgcggtgagccaagatcgctccactgcactccagcctgggtgacagagcgagactctgtctcaaaaacaaaaacaaaacaaaaacaaacaaacaaaatacacacacacacacacacacacacacacacacacacacacacacctggccgggcgcaggggcttatgcctgtaatcccagcattttgggaggccgaggtgggcagatcaactgaggtgggaagttcgagaccagcctgacaaatatggagaaaccctgtctctacaaaaaatacaaaattagccaggcgtggtggcacatgcctgtaatcctagctagttgggaagctgaggtgggagaatcatttgaacccgacaggcagaggttgcggtgagccaagatcatgcctgggcaacaagagcaaaaaacaaaacaaaacaaaaaaacacctattatcaaaaaatgtgcagataaagataattacaacaaagaaaataaagaccagtgataatgccttttcccagagataactatggttagcctgttgatgtataatatacttacatgcattagaaatttgatttcaaccaaaggacatttagcatagaagagatcagacgactcgaaagctctttttttttaatatttattttttgagatagggtctcgcttcgttgcccaggctggagtgcagtggaaaaatcacggctcactgtaggcttgaactgggctcaaacgagcctgccacctgagcctcctgtgtagctgggactacaggcgtccactaccatgcctggctaatttttactttttttttttttattttgtagagacggagtttcactatgttgcccaggctggtcttgaactcctaggctcaagggatcctcccacctacggcctcccaaagtgctgggattacagccatgagccactgtgcctggcctttgaaaggtttcttacagcccattcaagactcatagccctgttcgccttccctttgcagccatcctccgtaactgtgacttctccaggacagtctctccaggatggctgactctggggtaatgagttcattccccaagggttttccgaatgctctgccctacggcatccatctccgaggcatcctaatgaacttggagcaaagctaaaagcccgacaagaataagctgacagacctgtttgctcccctggctaaaatggaatccaaattcattttggcctcaacttcaggggagatggtttgaagttgtgcttggtgcatttttctcagcctgtgctatggtcagaatgtttatgtcccccctaccccccccaaattcctatattgaaatccaaagccccaaggtgatgctgttaggaggtgggacctctgagaggtggttaagtcatgaggatggagctcttatgaatgggactcatgatcttgtaaagagctctgacagagatccaggaatgctttatgttttagtttgtttttttttttaacttgtttgctgtgtgtgtgtgtgtgtgtgtgtgtgtgtgtgtgtgtgtgtatttttttttttttcagatggagtctcactctgtagcccaggctggagtgcaatggtgcgatctcagctcactgcaaactctacctcccagattcaagtgattctcctgcctcagcctcccaagtaggtgggattacaggtgcccaccaccacacctggctaattttttttctatttttgtagagacagggtttcaccatgttggccaggctaatcttgaactcctgacctcaggtgatccactcacctcccaaagtgctgggattacaggggtgaaccactgcacccggagttggttttgtattttaatataacagtgcttcttctacttttccaccacattctggggaaaacagaaccactgaggcaactggcttccctgactctggctacccaagaccccacccagagggctgaggtgctggatcaaggctgtacctgtaggttgcacactacactccccagcccactgtggggaagctgttctctaccatcggttccccaaatttggttgggatcagaatcctctgggaatgtacagagactaaggccctgctctacccacctccatgaccttagagttctgtcttagctctcttggagattatgataaaaccactgctctataggcaaccagagcttctcagactttgctgtacatctgaaccactagggggacttttaaggatcccgattccagctgggtgcagtgactcacgtctgtaatcccagtgctttgggaatctgcagcggaggattgtttgagcccaggagttcaagaccagcctgggcagcacagtaagaccccatctctacaaaaaatttaaaaattatctgggtgtggtggcacacgcctgtgatcccagctattcaggaggctgaggcaggaggatcgcctgagcctggaattttgaggctgcagtgagctgtaatcatgctactgcactccagcctgggcaacagagaccctttctcaaaaaaccccaaaaatataaaattaaaaaaataaagatcttgatgcccaagtcaaaccccaggccctttaagccacaatctctgggggaggactgaggcatcagtggaagttgaagcttcccaggtgatttttttttttttgagacaggctcactctgttgcccaggctggagtgcagtggtgtgatctcggctcactgcaacctccgactcctaggttcaagtgactctcctgcctcagcctcccaagtacctgggattacaggtgcatgccaccatgcctagcttaatttttgtatttttagtagagatggggtttcaccatgttggtcaggctggtcttgaacccctgacctcaagtgatccgcctgccttggcctcccaaagtgctgggattacaggcatgagccaccacacccggccttcccaggtgcttttaatgtgcagccgcgtttgagacacactgctcaagtctgcatctagctggagcatcccacactttggtgtgtatgtcatgaaacccgtatctcaggctctcactcaacaggactggctgggacctcggggaggctgcatgctgctactcacagcctggtgggagacatcagcttcagtatcccctggagctcgttagcaatgcagaatctcaggtcctacccaaacctacgaagtcaaatctgcgggtttttttgttgtcgttgtttgttttttggtttgttttttttttttttgagacagagtctcgctttgttgcctaggctggagtgcagtgacgcgatcttggttcactgcaaccgccgcctcccgggttcaagcgagtctcctgcctcagcctcccgagtagctgggattacaggcgcgagccaacacgcctggctaatttttgcatttttagtagagacggggtttcaccatgttggccaggctgataacaaactctgacctcaagtgatccgcccaccttggcctcccaaagtgctggggttacatgtgtgaggcattgcacccagccgaatctgcgttttaacccaggtgattcaggtttacgttagagtttgaaaagttctgagctagaccagcagggcccagtcctgccttatgcagggtccaagatgaagagcctggctgaagacacgtgggtcagtcataacagtggtggacagcagaggtgctgttctcctgacccttaatgttattcacagccccatcagctttttagattcctcttttagataacttactaactctagaagctctttgagaggccacacatcagaaaagacactatcaatttctccttgtcctcctggcatttgcatagcatcttccatccaacgcttgaaatgtatttcagatgtcaacccaccagcctaccccaggaagtgattttagacaccttccctgtatcattgctatttctcaaaataacacagattgttggagctgatgggaatttagctcttgactggattcctttatctggttgcggaagaaagctttttttttttttttttttttttttttttagacaggcagagtctcactctgtcgcccaggctggagtacagtggcacgatcttggcacaccacaacctccacctcctgggttcaagaaattgtcctgcctcagtcactcgagtagctgggattacaggcatgtgccaccatgcccagctaatttttatatttttagtagatatggagtttcaacatattggccaggctggtcttgaacccctgacctcaagtgatctgcccaccttggcctcccaaagcgttgggattacaggcgtgagccatggcgcctggcttttgtgtgtgtgtgtgtgtgtgtgtatatgtgtgtgtgtgtaagagagagggtcttgctctgtcacccaggccggagtgcagtggtgcaatcatagctcactgcagccttaatctcctgggctcaagtgatcctccaacctcagcgtctggagtagttaggactacacccagctaatttttaaactttttgtacagacaggatctcactgtattgcccaggccggttttgaactcctggctcaaaggatcctcccaccttggcatcccaaagcattgggattacaggcatgagccaccactcctggctgaaagctgctttttaatagcactaaattttaccatgatgttttcaaaagcttttcttccctctcaaaagaagaaaatatattcatctttgaaaaaattgctgtgtttcattgtgaggtagtgggaaggcccactggctggccatgagctaactgggagcccctcaagggcagaggccttgttttttttagcttctgtgcccccattgccaagatagggcgggcacgccgtagccagtccctatgaacgtgactctggtgtgcatgaaagaataaactgaggcttcaacagagactttaattccccatggctgctgctgtttcagttcttaaatggagctaaattaactctgggttgtgaagggtaatgacccagagtcatgcagatgtactgatggctccaacaacttccttactttgagaaacagtgatgatacagggaaggtgtctaaaaccccttgttagggtatgggataggctggtgggctgacatctgaaatacattccaagcaatggatgaaagatgtggctactagaattaattaaatcatctaaaagaggagccccctagtggtgctcggctttgaggcacaggtgtgaggtctctgctctcacagagcttactgcctggtgaggggcgccatggactgctggaatcaccatgctgatccatgaatattcttatgagggaggcgcccggctctcagtgtataaccaaagaacttgacctggactttagcatctacattgctttctatgatagattctgaagccgtaagatggaatgagacttgcccgccctcaaagagctcaggtgctgagggagagatgtataaataagcaatgatcatattgtcatgggtgtatgtgggctggctgtccacagaacccatgctccccttcctctcacaggaatgtcatggtgacagggcaggtggcccctggatagatattccccagggtcgcttgcagctacgtgtggctttgtgactcacgtcttgccaatggagatgccgacgatgaatgagtggaaatgatgggtgccgcttccaggcctgggctttcagatatcatttggggacctctgagctctttcccatcacacgtggatgtgtctacagcttaagttcaacaagggcaggcgaggacagtggcctgagtggtgcctccaggtgtggtccctggaccggaggcatcaatgtcccctgggaacgtgtcagaaatgcaaatgcttgggcccactcagacctaccaaaatagaagctctggggccaggcacagtggctcacgcctgtaatcccagcactttgggaggccgaggcgggtggatcacctgaggtcagaagtttgagaccagcctggccaacatagtgaaaccccgtctctactaaaaatacaaaaattagccaggcatggtggcaggtgcctataattccagctactgaagaggctgaggcaggagaatcacttgaacccaggaggcggaggttgcagtgagctgagatcgcgccattgcactccagcctggtccacagagcgagacccgatctcaacaacaacaacaaaaaagaagctctgggcgtgggaaagtgcttaacaaggcctccaggtggttctgatgctcaagacaatctgagaagcacagtcctgggggacgagagagaaacaaaacggaaagagcccacgtccccaaattccccctggagctgagcggccccgttagcctggcttcttacttctgggctcatatgagaaagtgaaatacatttccacactctttaagtcaccgtgtttctgcgtctcttggtcacagcagctttgcatctcactaaccgatacagtatttcaacagaggttagtatactggatggctgccttgaaaatgcttttaaacctgagacagaagtactcatttaagagcttgtatttgggaaactcaatacaatgaggcactcaggtctaacaaggattccacctagtgaaactgtgtttatttctagggtctaacattttaccctaaaattctgttagatgctaggcccaccagatagcactgcttttgcaccaacattcaggctgggttctcctagcgttcatcgtgagcattaagattcccccctttcagctgtaagaaaaattggctttgaattgtcacaagaatttcactaactgagttgacatcttggcattccctcaagaatagaggtcacgttcgcttccacacagggatctaaaagggaggggagggccgggtgcggttgctcacacctgtaatcccagcactttgggaggtgggcaaatcagttgaagtcaggagttccagatcagcctggccaacatagtgaaaccctgtctttactaaaaatacaaaaattagccaggtgtggtggcaggtgcctgaagtcccagctacttgggaggctaaggcaggagaatcgcatgagtctgggaggtggaggttgcagtgagcagagatcgcgccacttgcactccagcctggacaacagagcaagactctatctcaataatgataataataattaataataataataataataataataataaaaggcaggggaagtcctaattcacctggatgtcataatcgctgtggcagcaaagggcacagcctttctatctgtacacgtggatgtgtaaggtggcattttagcaccacatgatcaattctgctgtttctcagtcatcctaggctggagctgaatgtcctgacccctgaagggagtgcagggaacgaggtgccctcccacccagacacccagggctctacgtttgcagtaggaacaccgtccccctcgcagggggatgactcttccccactccgacttcaaccactttgcaaattaagtactgtgataggcaagcttgatacattttacagtatgggtctcaattactcaacttacatcttgagtgcccgatagcatccagctggtctaataacacctaatcacacagatgctaaacaagtccagggattcgaagctttgggcagggcatgggttgtaatggacttgagagacaaccacagtttcttaggaagagcacgcggggtccgaacgacgctggggcctgctggtcacctgtcaccttatctggtccttattaaggtcaagaaaattagagaaggttggcagaccagcggttatacttaagaacatttgacaaattagtgcagaataaacaacagaaagagaaactagatccaccttccgtgggacccttcacgctatccactccctcacctagctggccacccagacactccctgaccattgcttcggccttgcaggtagaaatcaaaactcttaatcaacaggagaagatgttagaagtttactcgtggcctgaggctcttacatcagcccttactgactgtgatgttaattctttctgactgctgggttattcaagttactcaaactggaccacggtgttgaccggcacgtatggaggaacacaaacctgtgtctggtgtgtttgtacagtctataaaccttacagtctagaatgaattcattgtcattcgagtctatcgcagctctactgaagtgggcagatcaccacacgggggacgaaaaggtagttgagcgatggcgtggctgggccacgtctcagcttcctagagctgtgggaacaaattactacaaaccgtgtggttctaagcaacaaaaatttattctctcacagctccggaggctggaagtccaaaatcaaggtgttggcagggtcacgctccctctgaaggccccaggagaaaatccttcttcctcatcttttcctatcatctggtgacctctgataacacttgacattcaatccttgatttgtagacatcactccaatctctgcccccatcttcacataacccacttctctgtgtctcaccgtgtcatcttcgctccttataaagataccagccattggtcttaggtcccactttaatccagtatgacctcaacttaatcatatttgcaaagacccactttccaaataaagtcatattctgaagttctggatatatatgaattctgggggtaaactctgaactcagtatagtcaggaacccagaaatgtggccacaagtctgtgctcactactacaaagaatcagattttgttgttgttgttctttgtaatacctacaagaaacgcctctctgacaattgtatggcgtttcatggctgtgggagaggaatgtatctcagggtgatgggagcatgaactgagaagcagaatttataacctatactcacctcaatttttttcacttgtaaaatgagaaaattgagatccggccagctaagtcatttgtccaaagccattaaatagctaataagcagcaaaaataaggtgagaaccccatatcattcattcattcattaaacacatactatgtcaggcatctcactgaagaaatgaggaagtgggtggaggtggaatatgattcctgccttttttttttttttaaatggagtctcactgtgttgcccaggctggagtgcagcggcacgatcccggctcactacaacctccgcctcccaggttcaagcgattctcttgccttagcctcccaagtagctaggattacaggcatgcgccaccacgcccagctaatatttgtatttttagtcgagatggctaggctggtctcgaactctggacctcaggtggtccgcccgccttggcctcccaaagtgctgagattacaggtgtgagccaccgtgcctggcccgtgattcctgccttctatttatgtggagacaaaactaacagcagcaaactcaacaatcaaatcaaggtgctaccacagaggtcagtaaagggtagaggggccaagaaggagatgatcgattcaggtaaggagaaggttaggaagggctttatactcaatttgagcctaggaagatgaatgggacccactaggcactgtgatcagagagggggagttccaggcagaagtcccatgcaagtgtggtgttgcagcatgggtaaagacggagcaactgagaaccagcctggcactttcaggaaaccctgggtggtcccttattcctgaagcccaggaggtcagggagcagaccaggaagggccttgagtgccacactaagagtgtgggactggtatcatgtaggcaggtgtcatcaaatgaagggttatttaacagagaagtaaaaagattgctgttacattttatttttttgattgagagtgtgggggggtgggtctcactgtgttgcccaggctggtcttgcactcttgggcttaagtgatcctctggcctcagcctcccaagtagctgggattataggcgtaccaccatgctctgctgttacattctagaaaggtcacttcaacctagtgtggagaatggatcagaggtgaacaagataaacaagcagaccgaggtgggcggatcatgaagtcaggagttcgagaccagcctggcctgaacatagtgaaaccccatctctattaaaaaatacaaaaaattagccaggcatggtggcatgcacctgtaaccccagctactcgggaggctgaggaaggagaatcgcttgaacccaggaggcagaggttgcagtgagctgagatcgtgccactgaacttcagcctgggcgacagagcaagactccgtcttaaaaaaaagaaaaatcaaacagaccaatgaggaaaccatgggagtctagatactggctctggtagggagacggggtggagagccaggtggtgagggtggaagagccaggggatgtggttaggatctggatgctggggaggggggaaaggaaggcatatctgggctgaccaccagggagatggtgctgtgctgttccgcacgcttaggaaaagagcaagtggaatggggtgcagagttcacatagggccaggctgaacttaggaggcctttgggaaactgagaagcacatggccagcagacaggaggactgatagagatggaattcacagggagtttgggctgaagacggagctgagcaactcatgacttgtaggggcaggggaagtcctggctgtgggaggctcatgggccagggggagcatgggtcagaaggctgggctgcgtgcagagcctttggcccaaagcagcatgggggggcgagcagaggaaggaagccgcatgctcacttctccagtagctagcttccttccttccttccctccctccctccttcctttctttccttttttttttttttttttttgagacagagtctcacccaggctggagtgcagtcgtgtgatctcagctcactgcaacctccgccttctgggttgaagcaattctcctgcctcagcctcatgagtagctgggattacaggtgcgcaccaccacacccagctaatttttttttatttttatttttagtagaaatggggtttcactatgttggccaggctggtcttgaactcctgacctcaaatgatccccccgccttggcctcccacagtgctgggatgacaggtatgaaccatcgcacccagccctgaaggtttctttctatgttcttcaatctgtacttttcagatttgtggaggtaaaagattacttagtgccaataaaactaattattctttccagaccaaatattgaaatggtgctaaatggagaagtgacagatgagctatggtgtcaccaccaacatcagattacacagcacggatggacagtgtgttgttcaatgaggttgctggccatcgccactgggtgcaccgtggggcctactctcgggaggcagccgcctacagcggaaagcatgcagacaagtggttctgtgaattatctgaagcaaatgcattgtacttcacagactctgtagtagaaaaccaccagtgtgaatttagtgggtcacgcgctttgatcagggagaatgagttcgcagcagttcatccatccacgccgcccagcctgactccctttcatgccatcccatcggcacggcttttcagtattcttgctagggttagggtgcagcctcctacttcagagcaaagccacaagagcagaagtcatgaggccaccctccctgcctctctccgggagggtgtctcctgcccagcacagggcccagccccctcccctcactttagtccattctgatgtgggactttgaggctgtccaagaaagatgaggtgactccatcctctgggaccagctacaggaaatgctgtttctattttttttttttttttttgagatggaatctcgctctgtcacccaggctggagtgcggtggcgtgatcttggctcactgcaacctctgcctcccaggctcaggccattctccttcctgagcctcctgagttgctgggactacaggcgcacgccaccatgcccagctaatttttgtatttttagtaaagacacggtttgaccttgttggccaggatggtctcgaactcctgacctcatgatccacccacctcggcctcccaaagtgctgggattacaggtgtgagccactgcacctggccaggaaatgctgtttctaaaggctgctgccagctgctgccaactatgttttatcacttaccatttcctttttaaaaaaataccaaattcacattgaaatgcttgaattaaaaaagtattgaggttcaattcacttacaataaaattaatcattttaaaatgagcaactcagtgacgtttagtacatccacaatgttgtgcaaccaccaacactatttagttccaaagcacgtccacaccttcagaataaaacctcattccattaagcagttctccattaagcagttctcttcacttcccgctcctcccagatcctggcaaccaacagtctgctttctgtctctacagatttacccattctggacatttcacataaataaaatcacaaaatatgcagtcttttgtgactggattcttcctttgttttcttttttacttagttttttattttttattttttttttttttgagacggagtctcactctgtcacccaggctgaagtgcagtggtgcaatctcggctcactgcaacctccgcctcccgagttgaagtaatcctcctgcctcagcctcctgagtagctgggattacaggtgcccaccatcacgcccagctaatttttgtgtttttagtagagacggggttttgccatgttggccaggctgatctggagctcctgagctgaggtgatccacccgcctcggcctcctaaagtgctgggattacaggtatgagccactgtgtctggctcctcaatttttttttgttgttgttgttaaatagagacaggggtctcacattgctgtctaggcttgtctcaaacacctggctccaagcgatcttcttaccttggcctcccaaagtgctgggattgtaggcatgagccaccgcacctggccagcttttttcacttagtgtaatgttttcaggattcatgcatgttgtagcatgtatcagtatttcattcccttttatggctgaagagtattccatgatgcaggtgcaccacatttagtttatcggcccatctgctgatagacatttgggctgtttccatcttttggctattgtgaataatgctgccacgaacatgtatttgagtacctattttgaaccattttacattctcatcagcaatagctccaatttcttcacatccttgccaacatatgttattttccactttttgggttatagccatcctcgtgggtgtgaagtggtaccctctcttggttgtgattcgcatttgcctaatgactaatgatgtggagcatcttttcatatgcttgttggcatcatttactttaaaaaaaaagtcttaacattaaatattttgaattttgtaacaattcaagttttcagaaaggttgcaagtatagcataaagaaaagtttcctggccgggcgcagtggctcacacctgtaatcctagcactttgagaggccaaggcaggcagatcacttgagctcaggagttcgagactagcctggacaacatggtgaaaccccatctctacaaaaaaaattagccgggtgtggtggcacacacttgtagtcccagctactcgggaggctgaggctacagtgagctgagatcacgtcattgcacaccagcctgaatgacagagcgagaccctgtctcaaaaaaagaaaagaaaaaaaaagtttcttgaaccacttgaatgggagatgtcaacctaactgcctgtcagccctgaatacttcttatttcctacacagaaagacatgatagagccatcaaagttaggaaactattattgatacgttaccatcatctaatcctctaacgctattcagatttcatcaaatgcaccagtaatgccctgcacggtagtaaattcagctgagaatcacacgccacatggagttcttatgcctctttaacccctcagcccttccttgactttgacgacccacagcactttccaagatagcggccgttattttgtagaacacccctcaattcgggcttcttttctgtctcctcataagatgcaggtgttatcctttgccaggaacatcacagaagacaaactgcattcttctcattgcatcctatccagtagcccaagatgtcaccttgtcccattaatgatgttcgttgtcatcacgtgattaaggtggtgtctgccaagtttcttcactgtagttactttttatttttgtaatgaataagaatttgtggaaagataccttgaaactgtctaaacttgttccttatcaaactttcaatatattcaattattggctgctattaggaggcactcagggttttctgttttattcagtaggctacaattcattactatcagtatttattttgatgtataaattgtcctggatttggccagtgggagccccttcaagctggttcctgtgtctttctcgaatgtctttatcatttttgattaatttctgactttcctaccattgcctattcaaggtgctagaaaaaggctcctgtttcaaattcctaccaaactgctgatttcctctttctctcaccctggccatgtgtctctgtcaagataaaaaaaagcactgcaagaggctgggcgtggtggctcactcctgtaatcccaacactttgggaggctgaggagggcggatcacctgaggtcaggagttcaagaccagcctggctaacatggtgaaaccccatctctactgaaaaaaatacaaaaatttgccaggcgtggtggcccatgcctgtagtcccagctacgcaggaggctgaggcaggagaatcacttcaacccaggaggcggagtttgcagtgagctgaaatagtgccactgcaatccagcctgggcggcagagcgagacttcatctcaaagaaaaaataaaaaataaaaagaagcactgcaaaagagataaaatgtagttacccacagggcagagattctctctctctctcttttttttttttttgaaacagggtttcactccgtcacccaggctggagtgaagtggtaccatcatggctcactgcagcctcaacttcctgggcttaagtgatcctcccacctcagccacctgagtagctgagactacaggtgtgtgccaccatgctggactaatttttattattttttactttttgtaggacagggtcttgccatgttgccctggatggtctggaactcctgggctcaagcagtcctcccactttgcctaccaatgtgctgggattatacatgtgggccattgcgtcctccctggaccgagattcttgaatatgtagtgcccagcaccagcaggaagtcagtgagtagatttgaccattggttggatgtatatctgtgacttagggtccataaagatcttttgaagaactgggcactaatcccaacttcgcattagacaatgttgccaagcaggtgggttgttttttagcatatttgagaagggggaaagagcccactaactttctgggcaaatttgggcaaattaccaaccattgtgggtctcagtttcgactgttaacagggttgcctgagcattgccagtatatatgatgaagtattggccaggtgtggtggctcttgcctgtaatcccagtctttgggaggtcgaggcgggaggatcgcttgagtccaggagttcaagaacagccgaggcaacatagtacgacctcatctctacaaaaaataaataaaattggccaggtatggtggcacatgcttgtagtcccagatactcaggaggctgaggcatgagaattgcttgagcctgggaggttgaggttacaatgagctgagattgtgccactgcactccagcctgggcgacagagtgagactttgtctcacaaaaaaaaaaaaaaaaaaaaaaaaaagaggagaaagaaaaagaaaacgaagtacttacaaatataagggttggctcctcattggttatcagatggaagacagcccctctttagcccaggacaacgtcgaagattgactagacattcagactcacaagacgatgacagaacgtgctccgatctattcagaaggatggggacagaggccctggcctgccagcagaacaatgccaggctgccttgtgtgaggagtcctggagaatttctcacagcagagtatgtaacatccaggagttatcttagccccatgtgatggtcatggtgcaaacagacggggccttcacagggaggtgcagggtctgcgtgggaagatgcgcaccacagggcagtatctcggggacgtgactttcacaagcgtcactgtcttggttcacctgggctgctataacaaaataccataaattgggtaggttttttggagacggggtctcactgtcacccaggctggagtgcagtggtacgatcatgactcattgcagccttgacatcccaggctcaagtgatcctcctgccccagcctcccaagtatctggaactacaggtgcacgccactacgcctggctaagttttgtatttttagtaaagatggggtttcgctatgttacccaggctggtcttgaacacctgggctcaagtgatccacccgccttggcctcccaaagtgctgggatcacaggcatgagccatcatgcccgtcctgggtagcttttaaactacaaaatttattctcacagttccctgagcttagaaattcaggctcagggtgccagcatggtcaggttgtgacaagggcccttttctgggcggcagactgttcacctctcactgtgtcctcacatgagggaaggggcaaacaggctcctcaggcttcttttataagggcacaagtccaattcatgagggctctgcccccatgatctaatcacctcctaaagccccagtactactgcactggggattagatttcaacacagaattttttttggaggggtgggggggtcacaaacattcagaccatagcagtcaccaaaatgctgagaagttcaaagcatggcgtctacatcagatatttaaattccattcctagctactcccagtccatatgtaattcaccagtcaggggccatttttaccataagcaatgttgcctggcaatgtagttgacatatagcatcttaactggtttacagggtgaggcaggcagaataatggcttcccaaagttatctgtgtcctactccccagaacctgtgaacatgataatgggggttttaggttgcagatgcaattaactaaggttgctaactagctgaccttaagacaggcaggttatcatggattatcctagtggaccctatgcaatcacaaggggccttgtaagtgaaagagtgaggcaggagagtcggtgtcagtcagagagagagatgaagatgctacactgctggctttgaaggtggaagggggccacaagtgaagggaagtgtccagcctctagaagctggaaaaggcaagaaggattttctcctggtgtttcctgaagaaacacagctctgccaacagcttggttttaccctactgagattcattttggacttctgacctctagaactgtaatataataaactggtgttaagtcactaagcatgtggtaacttgctacggcagcaatacagggtaacagagctaggtagttgccaaggttgggttctcatgcagcagaggaagagggtgtgtgaacctttcaagcagtcctgacatataaggctggcaatcttcacctcctgggttcaagtgatcctcccacctcagcctcctgagtagctgggaccacaggtgtgagtcaccacgactggctaatttttgtatttattgtagagacgggcttcatcatattacccaggctggtgtcaaaatcctgagctcaagtgatctgcctgcctcagccttccaaagtgttggaattacaggcgtgagccgctgcgcctggcctagattctccatttcttctgtgtgatctttggttgtttgtgttttccatagaatttatccatttcatttcagctgctgaatttatggccataacattctttgtaatatcctttttatgtatgtaggtctgtagtgatgttccgtctttcatttctgatattggtcatttgtattttttttttcttggatggtctggctagagatttatttttatgactcttttcacaaaagcagcttttggtttcattgactcttttttctgtcctcaattttactgatttctgctttattattctatattatttcctttctctgcttcttttgaatttctctctctctctctttagtttattaaagcaaaagctgaggtcagtgattagagagaccttcctttttttctaaaataaacatttttgcctgacacagggatcagggttcaggcagatgggtgcctgtgcagacgtatggactgagctgctcctgccgtagccagcaaccctggggccctgcagctgaggctgcatgggggtggctgctgtctgcttgagtgtcaggcttatttggtgaccatgaagctgctgtacctggccttccacagctgcctcctactggccctgctcagcgcatggtgaactgctcctgaggatcatgcgtcacccacaggcgtgcacgctgtcagtgctacctctttcctgtgggataaactcagcagctgaatctggatgtggcagtgggctgggagcagcctcatcctgctcaactacctggaattgggagtgaggtgggataaggtcactgagcccatgcagggacagaggaacctctcgatgtgctttagttctggagactgctttgctgcccacaatttcagtggcagtcatggattggaaggagtgagctccaggagctctgccgccattctccaggagctagattcctggcccgcacctctgtggaccaggagaacgagagaatgcatagatcgaagaggggaggctgagcacaattgaagtgtggggatatagtctcctctgtgtgaccattatcatggattatcctggtggaaccaattaccatggattatcacaagggaccttgtaagtgaaagggcgagcagaagagtcagtgtcagagtcagagagagatctgaggacgctacactgctggctttgaaggtggaagggggccacaagcgaaggggagtgtgcagcctctagaagctggataaggcaagaaaaaggattctctgtcatgctgttcaatgctgggatgaccatctagtgcaactgaagtgtggggatacgatctcctctatgtgactgtcatctccctctgctccctcatgggcaccatcgtggtgccttcaagaaggccttttacagaaggaagctgctgctccacgtcatagctctggcgattggaatcctctagtccaatgtgctctcctagctcattcctggggcttttgatttcaaccctctggaagatgattatgtgtccaagtctgcagtggtgtctgggggcttttatttttatttttcagagatcttgaagatgtttctcaaacaggaaaatgaacatcacatagacatagccattatgcctctgagaggcttccttccaagaagcaccaggaggaggggggtgatggagaagctgcagaatggggacctggaccacatgagccctcagcactgccacagtgaactggatggcaagcagtccatgatggatgggaaggtcgtggtgggctcactctctgtgctggttctgcaggctccccagagtgcctgctggagctgaaaggtgtccactactttatcagcactctggcctgggtgatcaccctaagcaacagcctccacaatgtcctcagcagcctggccactggcgcctctttcaccgtctgtgtggtccaaggcctcggcacctggtggccgtcttccatgaggagttcccacatgactttgtcatcctgcttagcgctaggaggaccattcagcactgtcttcttcaacccccttccgcctgctgctatgtgggtctggcctttggcatcctggccagcagccacttctctgccaactgaatttttgtgctggttggaggaatgttcttgaatattgctgtggttgatatgttccctgagacgaatgaggtctgccaagaggatgggaggaagggcagcatctccatcccctttgtcattcagaacctgggtctgttggccagattcaccgtcatgctggtcctcgtgatatattcaggacagatccagattgggtagggccctgccaggagcctgtgggatgggaagtcaggccctgggctgcccgatccctggcctgaggactcgccatccacaaagcaccgtggaagaggttgttccatgaaaaacttacacagattgtattcccgccttcagatgtcagcggtgtttacaatgctctgtcctaggaagaaacgtccctagtaaccagtctccaggtagtacctctcaccctctcctcacctccttttctctctgtgactctggaacctgaatgcagcttgcaagacaagcctttttctctgattaccctcgcctctttcccttggaaccagtgctgaaagatgtgtgtgtgtgtgtgtgcgcgcgtgttttgagatggagatttgctctgtcacccaggccggagtgcagtggcacgatgtcagctcactgaaacctccaccttccaggttcaagcgattctcctgcctcagcctccccagtagcagggattacaggcacccacaaacacacctggctaatttttttttttttttttttttcagtagagatgggttttcgccatgctggccaggctggtctcgaactcctgacctcaggtgatccatctgtctcagcctcccaaagtgctgccattacaggcgtgagccactgtgccctgcccagtgccgaaagattttgaatcctttacctgacaatgcaaaaatacagccagtggttttaacttggttagaaatatcaagaggtgaatccatagtttggggcccatgacattggctgggcatcctggacctccggctggccagttttgaaacaggttcacctcttcttacagagaagatgcaggaatccctcttattttttcaaagtctgcttagttgcctattacttctctcagagagaattctaagtgagaacagatgacagggtgagaggggaggcagggatcatccggagtgggagagaaagtgggacggatgctctgtgtcttgtcattttgctcatctgctcctagcagaatgctgggtattgatttgggggcagcacctggtatttcctggctgtccaggtgagctaatgtggaggtaatgtagcttcctggacctcctctttcaggtcaacactgacagaatggaaggtcagagagtctacaaggaaacaatgttttgctgtgattcccacttcccttccccactcctatcttctaagagacttgcaggctgggtgcggtggctcacgcctgtaatcccagcactttgggaggctgaggtgggtggatcacctgaggccaggagttcaagaccagcctgaccaacatagtgaaaccccatctctactaaaaatacaaaaactagccaggtgtgttggtgtgcacctgtagttccagctatttgggaggctgaggcatgagaattgcttgaatctgtgaggcggaggttgcagtgagctgagattgtgccaccgcactccaccctgggcgacagagtgagactctgcctctatctaaaaaaaaaaaaaaaaaaagaaagaaaagaaaagacaagacaagacttgggagctgcctccctaaaagcacattctgagcatatttcagacatctctgttagaaggcagactgcacaaactatcctcccctagtggagatatctgcacagtggcaagctgactggtagaattggaatgcagtttatgctctgcttaaacaagggtaatcagaaatggaatcagtgcaagcaaaatttaggatttgctacttccataaataaaagcatgaataacaggggtctctgaaatgtaaggtcacaaacttagtttggggcactgcagatgtttgcagaatggcagcccagtgattatgctacagatgggctttcaatcacctgtgtaggttaccgcttcctccctcacacacacacaaaaagtggaatccttcgttgaactgaatatgaatatgaattgctctgattctgcccagaaaatggacggatatacttgtctgtaaaaccgtgggccagcctcaggcacgctggatcccttgcctcagaactctggcttcaaggaaagctaatctgcagggctcactgtgtgaatcgatttattactatcacatggataacatgagtttctttagccaatttgggaagccagactctccagaagcctttctcagtggtgcctgcagttgcagcccaggggctgtgttcacaaactgattcgtgtgcatgattcacaagagtactgcttcattgccattgcctaaatttttaatctttttgtttttttttttttgagacagagtctcactctgtcaccgaggctggagtgcagtggcgtgatctcggctcactgcaacctctgtctcctgggttcaagcaattctcctgcctcagcctcctgagtagctgggattacaggcatgtgccaccccacctggctaatttttgtatttttagtagagacggggtttcaccatgttggccgggctggtctcgaactcctgagtccaagtgatcctcccaccttggcttcccaaagtgttgggattataggcgtgagccactgcacgccgccagtgagtttttcatcttcttagacagaaaactgtccactcttagtcattaaaggcagcatcagctgggtgtggtgagttcacgcctgtaatcccagcactttgggaggctgaggtgggaggatcacttgggctgaggagttcaagaccaccctcggcaacattgcaaacgctgtctctaaaaaaaaaaaaaaaaaaaaaaaatttatatatatatatatatacacacacatatatatacacacacacatatatatatatacacacacacatatatatatacacaaaaattaattagctgggtgtggtggtgtgggcctgtagtcccaaatacttgcagggctgaggtgggaggatcacttgatcctgggaggtggaggctgcagtgagccaagattgcgccactgcactccggcctgggtgacagagcaagactgtctcagggaaaaaaacaaaaaagcatcagttttgttttcccttcctgggagacatctctcaaaccagggatattcttgaaaagagcatgagcaaggaaactgctggtgatattacaagtttctctccttatcttgcctgttgacttcaatagatttgagaataggctgaagagggaggaaaacttcagtgattgagattctagatgaaatatcaggactgactcctgataggattatggtccaggttaaccaaaaaccaattccttgaatgttgaaatctaactttttatattatctttattattgttataaaaacagttcttcatcttttctgttttatttttctaaaactgctttcaggagctaccagaaaataacactcaaagtttatgactctggaagattttgctttccctaactcacatcgatgtattaaatgtataattttagcattccctatagatcttcttataccttaaaaataatagcctttgttttggagaagaaagtactaagttagagttagcaggtttcttgtttaggagaggagctcaaaaatataacctttaacaaattgaaaaataaaatatgaaataatagggtgctttctcttttgtgcacagctatattaagaaatttcctttcatagacagctacctcaaagggaaatccttttaaaactttcgttggaggttgggcgtggtggctcacgcctgtaatcccagcgctttgggaggctgaggtgggtggatcacctgaggtcgggagttcgagaccagcctgaccaacatggagaaaccctgtctctattaaaaatataaaaaattaggcgggcatgttggtgcacgtctgtaatcccagctacgtgggtggctgaggcagaagaattgcttgaaccggggaggtggaggttgcggtgagccgagatcacaccattgcactccagcctgggcgacaagagtgaaactctatttcaaaaaacaaaacaaaacaacacaaaactctttgggtgcagaggtcagtcctagtcggaacttagtggggctggagacagtcatattatctcctgactgtaagttgccgttggcaacagctttgcctggtgagttggacttctgggtgttgaatgtgcagtttgtttgtttgtttgtttgtttgtttttgagacggagtctcgctctattgcccagactggagtgcagtggcgtgatctcggctcactgcaagctccgcctcccgcgttcatgccattctcctgcctcagcctcccatgtagctgggactacaggtgcccgccaccacgcccagctaagtttttatatttttagtagagacagggtttcaccgtgttagccaggaaggtctagatctcctgacctcgtgatccacctgcctcggcctctcaaagtgctgggattacaggcgtgagccactgcgcccggccaaatgtgctgttttaagcatttgtacatctagaagtctaaggaatagccagttgttctaaagacttttcacccctggcattagtagcttcaacctctttctggatggaccagcccctgttaatgttaccaaggaaagtacatgtcacatgcaggaacagtaagccagcaccaggtgtctgctccttctcacctagtcactggcaggcaggctgcccctgtccttgctcctacaggtattttgtgtctaatgtcaattttgggggctattcctcattggtccgtcaccttgggtttaaaaaaaaggaggctctgtttgggttgcctaagatctggtcttagtaagccctcttctgacgagatggtaatatgctggagattagccaaaaaaaaaaaaaaagtctaatttttttttaatttttcttttttctttcctttttttctttttctttttcttttcttttcttttttttttttgagacagagtcttgctctgtcacccaggctggagtgcagtggctcaatcttggctcactgcagcctctgcctcctgggtttaagcgatcctcccacctcagcctcctgagtagctgggactacaggtgtgcgccaccatgcctggctaattatttttgtatttctagtagagatggggtttcaccattttggccaggctggtctcaaactcctgaactcaagtgatctgcccacctcagtctcccagcatactgggattacaggtgtgagccactgcacctggcaaaaaaaagttgtccgatatttgtgtgagaggattttattgttcatatttccctttacagttctgcaattccactgcagtattttaccctttttttttttggagacagagtcttgctcagtcacccaggctggagtgcagtggcatgatcacggctcactgcagctttgacctcctgggcttaagtgagcctcctgcctcagcctcctgaatagctgggactacaggagtgcaccaccatgtctggctaatttttgtatttttagtagagatggggttttgccatgttgctcaggttggtctcgaactccaaggttcaagccatcctcccacctcggcctcccagagtgctgggattacaggcatgagccaccgcacctggcctccagcacattgttttaaaaaataactcagctcttatgaaaagaaattagaaaataaaattaacttatgtggactgtaaatgatttgtaagattctataaataaagctatattctataaaaatgaaacgaaataaaatcagcatttaatggtatgaatttccctttaatcactgagtcccacacatttttatatcaattcaaaatattttctaatttctcttttgatttcctttttgaaccatgggctatttagaagtgtgttgttagattaggtgaggttagattctgatctcagcttaatttttagtctttgcaactccaagagacgtgagtagtggtatgaatcctaattctgttctcaaagcttttgctatgttactttggttctgtcctaagcatgtgtagctaaggggtgaggctggaacttttgtggttcataaaaagagttagatgaggctgggcgcggtagctcacacctgtaatcccagcattttgggaggctgagttgggcagatcacttgaggccaggagtttgagaccagctgggccaacatggtgaaaccccatctctactaaaaatacaaaaattcggccaggcacggtggctcacctgaggtcaggtggctcacccagcactttgggaggccgaggcgggtggatcacctgaggtcagcagttcgatcacctgaggtcaggagttcgagaccagcctggccaacatggtgaaaccccgtctctactaaaaatacaaaaattagtcaggtgtggtggtggaccccagctactcaggaggctgaggcagaagaatcgcttgaacctgctgggaggtggaggttgcagtgagccgagattgcaccattgcactctagcctggtgacagagtaagactccatctcaaaaaaaaaaaaaaaaaatagccaggcgtgatggtgcatgcttgtaatcccagctactcgggaggctgaggcaggagaatcgcttgaacccgggaagcagaggttgcagtgagctgagatcgcgccactgcactccaccctgggcaacagagcgagcctctgtttcaagaaaaaaataaaaaagaatgagatgatccacttctcacactctctcctctccagggtttctgccacaccctccagttcaaaagggcaccttttcctgtttccctgaccagaaagacagggtttatcttggagatttagcctgcatgcagccaccactgtgcaattctgaactggggcccgttcttggggcaaagctgtgagagaaaggagaaaaagaaaaaaaaggatcacagggttccctttccccagttcctctcgccagccatgtggggtttccatcagaacattcgctacctgcacggccaccgctgcagccctgctcttgggcccactcaggtcaaagccacaagaataaggagaaaacaaatgtaaaggacactcccatccacacaggtgacttcgtggcttctgcctgtcctccccaatccacatgctcttatgtgattcgtgagtcctcagggagttgctttttatatttttccagcgtttttgctgcagtctgcaggagagacgggctgtagcgggcttgctccatcctgggctctccatatgccactccctctgctgagaacgctcttcctttcttgtctggtgagcacctattccactcccataccttgcatcagctgtcctgacctccagggaatctttcctgacctccagaggatctttcctgaccactttcaccttttaaattcagagcggggggtgcctccgccacagcagcccccctcatcatgctgtctccccagcaaccagcagctggggtaggagaaagacctcctctttcatgcacatctctgtattcccagcttgcaaaaagctgagggaagaatgattatttctattatctatctgattctctactaaagagacaaaatggacatctaaaaatcacaataacacaaaaactccacaatgtttaaatgctgtgagccgaagacggagggtcctccgagcctttgcctggccagagtacaggtgaaaagcacatgcctgaagagcgtggctctagcagtcccttcaaagatcatctagtacttcagtctgtgtggccaattccttttttttttttttttgagacggagtctcgctgtatcacccaggctggagtgcagtggcgtgatcttggctcactgcaacctctgcctcctgggtgcaagcaattctcctgcctcagccccccgagtagctgggattacagccacgcaccaccacgcccggctaatttttgtatttttttttttttagtagagatgggggtttcaccatggtgcccaggctggtctcaaactcctgacctcaagtgacccacccgcctcaacctcccaaagtgttgagattgcaagtgtgagcccccgtgcccggctgccaattccattttgacatgatattgtttcaatagaaaggctatttttacaaagtagaaagtgacagttagaggaaaatgataattttgagttttccatttcattttttaactgaagaaaagacaaaagctgtcatattccagctcctagcattattcaagaagaatgaattttctataaccattcctcgggcaaaccattcatttttacattcctgaagaattaactttgttaaaaaacaggatgtctttgttccagagtatcaaggttttgcttaacattgtgtgcaattttgcttctcatttcatttgcttcctatgagatttttttagcgctaagacagatcaaagaaggtttccttgttgcctttggctccactaccatttcctctcccagctcctcagctaactggttatttgcttggccagtagtgctatttgcaaacaggctcctgaacactgggagaagatggttgctggtaaattgcagcttgtgggaatgtctgcaacacacagctgactttctggaacgtggggaaccgctgacctcaaacgtaggttcaaggaggaaccacagcctgctgaggacccacactgaggtgctggtggatgcgggcagctgccaagctgatgaggaagggtttccaagaagcaggtcagggccccagcctggcaaaggggctctggggctctgggggagggaacgaagattgatgtcttttgcaggccgaccctgtgacccacacaaagccacaagaatgatatccctttcccttgctttctcctcttgccctgggacagtacttttcttccccattttcctagccttcttctgcaaacttcccggcatttaaaaaaaataaactttattttttagagcagttttaggttcatagcaaaggtgagcacaaagtacagagttcccacataactcctgtccccaaataggcgcagcctcccccatgaacatcctgcaccagagtggtccatttgtgaccatcaatgacccaacactgacacatcaatatcacctaaagtccatagtttacaatagggctcactcttggcactgcacattctatgggctttgacagatgtctaatgacaggtgctcactattatggtgtcacacagaggagtttcctgctccacctattcaaccctccccaacgccacattcagagcaggaggtgcctccaccacagcaaccactgatctttatactgattccataattctgccttttccaggatgtcatatagtgggaatcacagtatgtagccttttcagactgatttctttcactcagcaatacgtatgtaagtctcctctatgttgtgtcatgacttgatagctcatttcttttttagtactgaatactattccattttctggatgtttcacagcttatttatccattcacctactgaagaacatcttggttgcttccgagtttgggcaattatgaataaagctgctataaacatctgtgtgcaggttttcgtgtgaacataagttttcaacccaggaaaattccaaggagtgcaattgctatagcatatgggaagaggaggtgtcgttttgtaaggaactgccaaactgtcttccaaagtggctgttgcattttgcattcccaacagcaatgaacaagagtgtctgcttctgcagatcctggcccgctttgtgtattctcagggttgtggattttggccattctaaatggtgtgtagtggtttctcctccttttcatttgcatttccctaatgacatatgatgttgagcttctcttcaaatgccatctttgtatctttggtaagatgccttttcaaaacttttgctcatctttaataggattttgttttgttttgttttctattgagttttaagagttcttttgtattctgagtgacagcatttatcagatgtcttgcaaatgtcttctcccaatctgtgacttgtctgctcattctcttgactttcccaagcttttcaaagctcatagggagggcctgggactagagggaggctagtgagggacctagaacacagaatttaaagaggtgatctatctcagggccttgcaagtgcgatgagacacggccgagtgcctctttaaattctcacctaattctggtcctgctgatgtggtcagacctcagctgcactaatgtccagccccaccgtctactgagcaaactcgtcactctctgataggaccttttccgtgaccattgctgccaagacagcagcttcataaagaacaccaggccgggcacggtggctgatgcttgtgatcccagcactttgggaggccaaggcagtcggatcacctgaggtcaggagttagggaccagcctggccaacatggtgaaaccctgtctctactaaaaatacaaaaattagctgggcgtggtggcacatgcctgtaatcccagctacttgggaggctgaggcaggagaatggcttgaacccaggaggtggagtttgcagtgaactgagattgcatcactgcactccagcctgggtgacagagtgagactctatctcaaaaaaaaaaaaaaaaaaaaaaaaaaaaaaaaaaaaaaaaagaacttagaacccaaattagagactgtctttgggactgggagactttctcatgacaaacaagaggaagagaaatgcaccatcgctactcacagacctgagggaggctctgtcacttggcagcatgactttctgaaagctgtcttatctctcctagcctggggttttcacacctgtggaataggtaaaatgcacttaccccatgacatagttttttgtttgtttgtttgtttttgtttttttgagacagagtctcgctctgtctcccaggctggagtgcagtggcccaatctcagctcacgacaacctccgccttctgggttcaagcaattctcctgcctcagcctcccgagtagctgggactacaggtgtccgccaccatgcccagctaatttttgtatttttagtagagatggggtttcaccatattggccaggctggtctcaaactcctgaccttgtaatctgcccgcctcggcttcccaaagtgctgggattacaggcatgagccaccgcacctggccgacatagttttagatgaaatgagatcatgtgagtgaagggtttggaaaactgtctggtacggcacagggggctgtgaggaagtggcagctctgatcaccactgatgcatgcaggaaccagctgcggcagtcaatctgtgcttcagacttgtgctgcagaccatttacaatggcctctccccaggacactgttggaaactggaaggcttccgggtatgttaacttcatcagagaggaagactggagtatactgaactctttgaaaggaaaatcaggatccttagtttcaaccatgagactggatagtattttgtgatatcaaccaatacttccccattcaaggaagggatgggtgtgatgggttaaaatacagatatggggccgggcgtggtggctcatgcctataatctcagcactttgggaggccgaggtgggaggatcacctgaggtcaggagttcgataccagcccgacgaacatgaagaaaccccgtctctactacaaatacaaaattagctgggcgtggtggcacacacctgtaatcccagctactcaggaggctgaggcaggagaatggcttgaacccgggaggtggaggttgcagtgggctgagattgtgccatcgcactccagcctgggcaacaagagcgaaactctgtctcaacaacaacaacaaagacaacaacaacaacaacaacaaaaaaccagacatggcccaagagtctttctggcttttgtttccaaaagcctaaaccccagaggtgagaaagaattcagagtatcggaggaaaatgtcttggccagaagcaggaggaagaagagcattgcctgcaggaccggagagtgaccctctctgcaagctggggtggttgggggccacaaagccttgttaggagacgggggggggttacaagaccctagaacaaaatggccattgggtgccctgaagcggaggaggtcatgggcagtcttgtggagagttttgtgtccccaggcaggacccaagaccaccaacagcaaccagcctaaagggtccccacccagatgatggtgtcctacgggtcacccagtggacagatacctggtcctgtgtaagttctggggaaacactgaggcaacccaagcaggccaaacaggcagaatgcatgcttcgatttgcgttttaaaacatttagaaaagtcacttttccccgcatatctgaatatggggattgagactcgcatcagccctattcactttgatccgcaggtgctaggtggtggccctttttaaagacagcttccctgcaggaagcccagcctcctttctctgtatggcttctctcagggtttgccattcccttcacttttgcatttgtagagtcttcagcttcctttggttctgagcaggacccaggagatggacatgcatttcctctctgacaaaactggcacttgttctccttggaagcgataaagtcaaacatttgcttgaatttttttttttttttttttgcttttttgtttgtttgtttttagagatggggtctcactctgttgcctaggttggagtgcaatggtgcaatcacagctcattacagcctcaaactcttgggctcaagagatcctcccacttcagcctcctgggtagctgagaccctaggcacgtgccaccatgccccgccaattaaaaaaaaaatgaagacaggggcttgctttgttgcccaggctggtcttaaataactggcttcaagccatcctcccaccttggcctcccaaagtgctgggattacaggtgtgagtcaccataccaagttgggataactcttctgaaatgtcaaatgcaattacaagaagcaaaaaaattggtcccaacttctcccatatggtatgaaaaattaaagaatttcaatgcagttgcctttactctcggggacctaggcctcttccactcgcatgcttttgcttccactattttatctactttacccctccttgactcagcacccaacacttcttgtgaaaagccatctctgccctccttcaagggttcattctgaggctaccagcctctcaaatttttctttcttttttctttctttcttttttttttttttaagattgagtcttgctctgttgcccaggctgaagtgcagtggcatgatctcggctcactgcaagctccacctcctgggttcaagctattcttctgcttcagcgtcccgagtagctgggactagcatgccaccatgcccagctaagttttgtatttttagtaaagatggggttttaccatgttggctaggctggtctcgaactcctgacctcagataatctgcccgcctcagcctcccaaagtgctgggattacaggcatgagccaccatgcctggctcaaagctttcttgagctgggcagccaccttggtccctggacctgagcactccccttcatttctatgacacttctgggtttttactgtcttcatcacattgttcccctctacttatcctttctcatgttggtggacaatgaattatttccaatattttcttttgtacaatgatgttatgagcatgtctcttgcacgataatttttccagggtagatactacaataggattagagttggtgagtagagatgccacacatcttcacttttacacttccctgtctgttaaaatagaatgagtaacctccattccccataacttcacatacactaaacgcacactcacaaaagaggctggtcatctttcttcaagacattcaagaattctcttgtgggactatttcagaaaggtccccacattgtcagcaccttaaagctgccagatacacatcttcaaatgccgtaagtacttgaatgtttgctgctgaaaacagcagcctgtgactcaactacttgaataatcaagaccaacagcctgatgatgccacgctctcatcacttatcagatgccgtcatcaaggctgagcagcaacagccgggtgttttgtttgtcccgggaattctgacgaaagtacacggtttgcaaagtgccagccagcactgcctgagacagcaattcaaggcctctggagcagggtcgcctgtcatacgcaagtcctgtctgatggctcaagctgccccaggaatgaccagaaagtcaccgtgggagtgtggacgcagctcagaatgacctagacgcatggcctgtagacttgagggacacgggctctggaagaggaactctgaaatactactgtagctggtgttagaaaataatcaattgggtggccagaggctgagatggctgttttgcctaggattctgacctaagcaaactaaacccaactcaatgtcaacagtaaaatgaaacgtgagcctaaccaatcaccagctaatttctaatgagagactctcctttttttttttttgagacagagtcttgctctgtcaccccggctggagtgccgtggcacgatctcggctcactgcaagctctgcctcccaggttcaagcgattctcctgcctcagcctcctaagtagctggaattacaggcacgcaccaccatacccagctaatttttgtatttttaatagagatggggtttcaccaggttggccaggctggtctccagctcctgacctcaggtgatccgccctcctcggcctcccaaagtgctgggattacaggtgtgagccactgtgcccagctgagactctccactttaactgatcaagtattttttctttgtcttgcttccaagaacaccttataaatgtttacccctcacgccccctcagtggagccctgaacctcttgcagtttggtgctgtccaattaatgaatcaccctctgctcggataaactctctaaaattgtaatgtgcctaggttgatctttccacactggttacatgctgctctatcagctgagaacctctgggaagcaccgtcctggagcatgcagcactgagggctggtgggcattgatgctctgagcggaggctcggtgcctggaccctaaagtggcttctgcattaacactgtttgcatgcccagcgtagcttacttttttcttttctttctttctttttttttttttcagacagagtcttgctctgttgctcaggctagagtgcagtggtgctatcttggctcagtgcaacctcctcctgggttcaagcgattctcctgcctcagcctcccaagtagctgggattacaggtgtatgccaccacgcccagccaatttttgtatttttagtagagatggggtttcaccatgttggccaggctggtcttgaactcctgacctcaggtgatccacctgccttggcctcccaaagtgccgggattacaggcatgagccaccgcgcctggccagttttttctaattcctatgagtggcaatacgtggatgagttctcagttaaccaaaagatagcaagaatacttccttctgtgcacacctcaaacagcagagtttaagtgaagcctgggagggcctgggaggtcaccagcagagggctgtgtgcggaggcttgctgcttcccagctgaacagcccgtcatgcagggcaaggcttagttgacatgtttttccttctttctttttttaagagacaggttcttgctctgtcaaccaggctggggtgcagcggcaccatcatggctccctgcagccttaaactcctcctgggctcaagtcatcctcctgcctccttcctgaggagctgggattacaggcacacaccaccatgcccagctagttattttattttttgtagagacagggtctcactagattgcttaggctggtctccaactcctgggctcaagcgatcttcccaccctggcctcccaaagtgctgggattacaggcatgagccactgcacccggccaacatgtttctcatctgtgtgcaaagactgaatacctaggctgcaaaatgagctcccagaaatgaattagaaaattctgccttacaagtacaaacagagaagtggttctggagatgtggtttaaccaactggaaaaagtatttttcagacaggaggagtggatgaggagccaggagacttgcttttaatcctatttctatttttaaaaattatttgtatgactttgaacaaggttttttctctttgtgttttagtcttcccttttgtaactgtctgtcgtcttcctgccccaaaacgattagaattaagtaaaatgcctcagctgggaacaaaaccaagatgacgacttggcacattcctagaatattagacattgtcatcggcctttgttgagattaagtaacaacttaatggctcgattctgaaaaaacaaaagcaaaaagaaaaagaaaaaacgtagtcacgtagttttcattctagattagaagcatggatgaaaccgaaagactattcaaagaaaattgcttttaaaagaggaaggaagaactaatcttgaaggctgtcacccacggacactgctgatcatctgttccatacattcaaaggatctctctacggtggttattcagaccttgcagacaggctgatgtctgttgctcaagtacgccatgcatggaagagagtatattggcagcagtgaaaaaaaatataggactcatttaaaaagcctggaaataatctggatactttccaggaaaaacgatgtagagtctgacgcagttgttgttgttttaatgagtgacagcctgctgctggtccctgcgatatggttgttcatggagacttgtccctgagcagcagagctggtggtatgaatggcaggctggggatggagacaagcagggataagttccacttcttcccaggagccaaaaaagccacagatgacaagatctgccctctgtgccagcaccccttcacctgaaatgacagaacttctcatgtaccatatggcgggacagtgctgggaagcctccgagcaagacagtctgccagggaggctggctctggttatttctctttccactttattttaaaatttaaaaaatttttatttttgagacagggtctcattctgttgcccacgctggagtgcagtggtgcaatcatagctcactgcagccttgaactcctgggctcaagtgatcctcttgcctcagcctctcaagctgctgggactacaggtgcatgccactgtgcccagctaatttttaaaattttttgtagagacagaagttcactttgttgcccaggctggcctcaaacccttggcctcttgcaatcctcccacctcagcctcccaaagtgctgggattataggcataagccactgtgctcagcctatttctcctctcaaccaggagtcacctggtggtgggtgaagaagcagctggatgggagaagtccaaccaggataaggccataaaaagcaagaaaaatgtacacatggcccagctcatggacagtctttataagcaaatagggaaggataaaaagacgagaatccaaatgtgagaagcagaaaaataaagctctggtcctaggaaaggttcatggtgggaaatgggaggattcgaaatcagagagagctcagattggggtcctacaggatggcacagttagttccactggtcactaactagtccccactcctccagggagggtgagggatcagctagtctcaaaattaccctccacccctgcaccaggaagactcactctctgtaaagcttcccagtcaatgcccttgtgtcacgagtggttactgtctggggccagtggcacgggcagtaaaaagaatttgccaagacagtcataggtacagaaatgcagatttattagcaaaagcatggaaatatgttgcaagaaagcaataggccagttagcaagagaggagctgactggaggagacaaaggcttcctggggattttataggatggagcttgttctgtgtgctggagagggctaagtgcagtattgataatgtcaaggtggctgtgaactaacttgcatttttctatcaaccgagggtctggtgatatctgggtgcaggaagatcgtgagtcatttgcgcagatgggctatgtgtcctagactatgaagaaacgcagatttatagcttatctgtattttctttctgctttcccttgctcccaccagcctggctccttgttcctaattaggaccccacagtaaggctgccttcctttgctggctggacgcagtggctcacgcctgtaatcccagcactttgggaggctgaggcgggtggatcacctgaggttgggagtttgagatcagcctgaccaacatggagaaaccctgtttctactaaaaaatacaaaattagccaggcgtggtggtgcatgcctcctactcgggaggctgaggcagaagaatagcttgaacccaggaggcggaggttgcagtgagccaagatggtgccattgcactccagcctgcgcgacaagagcaaaactctgtctcaaaaaacaaaaaacaaaacaaaaaaaagaaatacttcctttgctgaagtcagcagctgatagaggaaggcaatacaaagccgggtatagacagtgaataaatttagaaaatgtaccagaacatggcattgttaatgaaccatggagcaccagaaatggaaggattttgcaaaccatggttccaatggttttaaagcgcaaagtttaaacatttataaattaggtcccttctaaagtcaatcagacaaacgcagtctcttacagcctcttatggtttggatatttggatatccaaatctcatattaaaatgtgattcctttgggaggctgagacgggtggatcacctgaggtcagcagttcgagaccagcctgaccaacatggagaaaccctgtctctactaaaaatacaaaatgattcaggtgtggtggtatgcgcctgtaatcccagctacttgggaggctgaggcaggagaatcacttaagcccaggaagtggaggttgcagtgagctgagatcgcaccactggactccagcctgggcaacaagagcaaaactccatctcggcggggaaaaatgtgattcctgatgtatggaggtggggcctggtgggaggcgtttgagtcatgggggtggagccctcctgaggcctccccagaagcagatgctggtgccatgcttgtacaacctgcagaactgtcggctaaataaacctcttttctttatcaatcactgagcctcaagtatttctttatagcaacacaaaaccaactaatacatggctgtattttcagtatctgtcgccacagaagatacaacacgacaaagctgtgattaattcagtaacatacttaaattcatctttattaatcccaaaggcatctatgcatacttgcaaattaatcagcaggatacaaacacatggcagtcgcaattgctctacacaggtttcctgggttgtgcacctgtattcagagaccccttgcagtggctctgaaggcccaccttccaccttgaggaagctgaagggcagaagactgaaggtaacttaacctccttaaccaaccagttagtgtttgagaacctggtattgctgcactgccaggggacacccaggtaatggccaggaaccctcctcttgctagacaggtaagcccagactagtgtagggaggaactggctctctctctgtagagggagaatatcctgagagacagggctgggctgttttcaccgtgcttcctcatacctgcccctcctctgaccagccagagttatccgcactgcctcaaggagaatgaggacgattacacagaagtgcaaagaggaattttgctttttacttccaaagcgggttcagaaagccttcttcaggaacaagttttagacgctaaagcctttgatttatttgaggaaggctctttgggggtctcagaaaaggggaaccccaaaggcaccaggtcctgcggtgaggcctggggcaaggtctaggggagccccgtgtagaggagagcagctggcactgagcagcaggcctgcattccctcatctttgccacatggggagcagtgcctgcagcaagccacggccacgcagaggcacggtgcccacgctgagacctcccatcagagacctcccatcagagacctgcgtatctccatgggtcctccagcagggcaattgcctgtgccctgagatgttggtgagcctcaatcacattcctccatacaacaatctcatgttaagaccagagatccgatgaacccccaaagcagggtgggatccccaatactgacaggcgatggcatgcggatgccccagtgttgtacttctgtacctgggagggacacatcggaactggattctgggaccctatttccttgtaagtgcattctaggtctttccctgctaccccagctgctacctcttacccctagggcaagaggataccctaggaacagtgtggagttcgagtggaagccctgggtgccgtccttgctcctctaggcaccttgtcctgatggtgattctcctttgaaccacagtctcctccttcaagaatggggataaagatccctgcctccccactgcactccagcctgggcgacagagccagactccgtctcaaaaaaaaaaaaaaaaatccctgcctcctggcatttctgtaaagatcaagtggacagggtacatgaatgcttttagcaaactgaaaaatgctaatcaaatgctagtgattgctcctttgaaaatccaagcacagcctgcaaaatacttggaatataaattgagcagacatatcgggagtagtttcaggttatgcttacgtgtcctttatttaaaaaaacaatgcttaaaacaccacctaaaaattcctctgaccacctatttcagtcaaacgctggaagatgggggatgctttatattaaagaattagaatgaggctgggcgcggtggctcacacctgtaatcccagcactttcggaggccaaggtggggggatcacttgaggccaggagttcaagaccagcctgggcaacatggcgaaaccccttctctacgaaaaatacaaaaattagctgggcgcggtggcgcgtgcctgcaataccagctactaggggaggctaaagcatgagaatcgcttgaacctgggaagtggaggttgcaatgagccgagattgcaccactgcactccagcctgggagacagagcaagaccttgtctcaaaaaaaaaaaaaaaaaaaaaattagaatgaggaaaacaatgatgaggtggaaacagatgtttgaacataggagaattttcgatgcataaggatgctgcgggcacttaaccagatgtctgcccttcactacctggccagggtggcacttttaaaccatctgataatggagagaggcggcacagtctgtatgggcacacagctcactctgtggctgaagccacatgtgggtgcactgggcccaaggagctgacctctgctcttgtggcactcccagtccggcacagacttgaggagaccaccgaaaaggagcccaggccaatggcctgcaaagccacttccctctacttgaccaagaagagcttcccggaccctggctcctgcctgcgcatctggccagcttcatcttccaatgctcctggtctccgataagccccagctgctggactgctgtttttaaaccccttccaggcgggaggaacagaagagaggtgagtggacaggtgcaggccctggagcctgaatctgctcctttctagctccggaaatgtgggtaattcccttcacctcctgctttcttcccttcaaaatagaggaatggttgtattggtttctattgtggctacaacacattaccatatatttatggcttaaaacaatgcagttttattattttacagttctggagttcaaaagtctgaaatgggtctcgatggactaaaatcaaggtgccaggagggctgtgggtggaagctctggggagagttcgtatttctgccttttccagtgtctacagccatctgcaatcctgagcttgtggctcctcctgcatttttttttttttttaacattttactttaagttctgggatacatgtgcagaacgtgcaggtgtgttacatagatatacgtgtgccatggtggtttgctgcacctatcaacccatcatctaggttttaagccttgcctgcattaggtatttgtcctaatgctctccctgcccttgcccctcaccccccaacagggctcggtgtgtgatgttcccctccctgtgtccatgtgttctcattgttcaactcccatttatgagtgagaacatgcgatgtttggttttctgttcctgtgttagtttgctgagaatgatggtttccagcttcatccatgtccctgcaaaggacatgaactcattcttttttatggctgcatagtaatccatggtgtatatgtgccacattttctttatccagtctatcattgatgggcatttgggttggttccaagtctttgctattgtaaatagtgctgcaataaacatacatgtgcatgtgtctttatagtagaattatttataatcctttgggtatatacccagtaacgggccctcctgcatttttaaagccagcccagcagcatcccccaccttctctctcagatgcgcctatcttcctcttatgagaacctttgtgacgacactgggcctgccaggtattccaggatcacctccccatctcaggatctttccgttaatcacatctgcaaaatcttttttgctgtgtaagattcacagattcacaagttccaaggattagagggtggccatctttggggaccatgattctacctaccacagtagtcatcaggaataagtagttcatacaacataagccactaagagcctgggctgcaggaagcacttaattaatgtgagccataatcattctcccttgctgaaacagagcccccagcctggaaggctttcgccttgcactggctgtgccccaatagttccatctggccaaatcatgagacctccttccagatgccttccctgtccttctgggccgggcttggtgtccttctgtgttgaggtgggagcttttcttaattccgtgttgtatgctttttttttctgagacagagtcttactctgtcgcccaggctggagtgcagtggcactatcttagctcactgcaacctctgcctcctgggttcaggcgattctcctgcctcacaaccagctaatttttgtattttcagtagagacggggtttcacccacgttggccaggctggtcttgaactcccaatctcaggtgatctgcccgccttggtctcccaaagtgctgggatatcaggcgtgagccaccgtgccccgctctgtgttgtgttataatcctctgtctccctcactggattgtaaatgcctcaggagcagggatggcctctgacttattttgcattcctacccctaggacatggcacacagcagctgtcaaatgtctcctggacggctcatgggtgaaggtaggtctgtgtcctttggggtgtccagaacctcagagctgccgttgctgctgtgggaggggagcagtgagggggtctctaggtggggatcttgtgctctgacagaggcagctcttcagggtggtagctggtttccccacagagaaggctgtctctcaccccaggcagaagaggacagatccatgcattcagcctggggaggagacctggtgttgcaggcacatcatgcttacggtggtcaaaccctcacagccccacgaggagcgggagaggctggcataggacacaagagcctggggatgcttaggcaggttggggggaatcagatatcaggaataaggacccacagaaatcatttggttcaatgcatctcaaatctggtggctgcaaaactcaaagactaattcccggaccctagcccagacccactatgtcagaatgtccaggggatgaggcccaagaagggatattttaaaaactgcccaaaatgtatgcagccaggtttgagaaccactgctgcatctaccttaggctttatacacagactgtgctacaagtaaatggttctcaaaacaggtgtgtaaaacagaagaaaggatacacacatcattcaacagactacagtgaacctgccagaccacgcatcaaggcgaatacataagacagtccttgccaagctgcgtccttgagcccgcctgaatcccggcagggtggagttgagggcggcctctctacttcatttagcccaccagaccttcggacctgagggtctctgatccagcctctcggggccaccaccccctgcagggctccaggaagagtcaaattgcccggtgggccagagctctccctcccttttgttgccgcttggcgcctggcaggtcagaggtcactgggcccagcagccccagtccctggatgggtggagcacccacaaaacagccaggctgtgaagaggcccactttggagtgagaaggggctgcttcttgcgtgtcattttgcaaaaagaatctctgtctcttcctctaccttgagttacactaccaaatactccttttggttaatgtagctttcttatatgctaggggtgagaggaggggaaagccaccttattctgtcaggaaggcacttgggcataaattaatctgtaggccaagtgcagtggctgatgcctgtaattatgcactttgggaggccgaagtgggaggatcacttgaggccaggagttccagaccagcctgggcaacatagtgagaacccatctctacaaaaagttttaaaagaatttagccgggcatggtggtgggcaactgtagccccagctacttaggagactgaagtggaaggctcacttgaactggggagctcaagattgcaatgaaataccatcacatcactgcacaccagcctgggcaacagagcaagaccctgcctctaaaactaaataaataatcggcggggcacagtggctcacgcccgtaatcccagcactttgggaggccgaggcaggcggatcacctgaggtcaggagttctagaccagcctggccaacatggtgaaaccctgtctctactaaaaatacaaaaaattagctggcgtggtggcgggcgcctgtaatcccagccgctagggaggctgaggcaggagaatggcttgaacctgggaggtgcaggttgcagtgagccgagatcgcgccactgcactccaacttgggtgacagagcaagactccacctaaaaatataaataaataaataatctgtgactccatcaacactttcacctgttggctccacgtgcatcagatgagctcatttgggaggtcaccttaacctcggatcaacatggcaggtcctcccacaagcagcctatttaaaatgtgagccacccccttccccggaattccctacctcccagccttgttttatttttctctcatgcacttactatatcttaaatgcttatttattcatgtacttgtttaaactacttttgattttctgacttcttatcattggtctgattcctccaccgtaacagaacttccatgagggcggggatttttcgcttcccccgcaactgcctgcgttttcgtagccctagagcttccaacgtacagtgcggaaaagcaacataacacactaagaaccgtgcggaaaaggagagaaaaccagaccgcaggggcatttcacagctaaccacagcggtccgaggcgaacgcagggtggaagaacccgagcgaggcccggcaggggcggggtgagccttggccccgctcccgtgcaggtgtcgcgggtaagctgccgcggttactgtgaagcagggccaaggccagccctccgcctcgaggccactggtgcttgggggtgggaaaagagtgaccgggggcaactgagcaaaacatagaacagaaactccctctcgaatagagacccacgcacggaaggatgatacactgtgattccccgacgtgggcctgcagcaagagacgggtgctaacagcgtccgagccaatccgtaagcatcagagggacaaagaaatcataaacaagaggcaggatgcaactgcttcaacgcagaaagaatgagtcatccaggaaggcgaggtggtggcgggttggctgtggttttgcagaggcgggcaggaggggcagggggccagggagagggcagggttgggagggtctcttttaagggaatcctatgcatgaaagtctgtgtaagaaagggtgtgcctcctacagaaggatatttgttttgtcctaaacttgccgtgtgttcttggaggcgcgggcctccctgctgtcatcacacctcggatcaccccaggcaatctcgcccctgtggcttcacctgggtccagccagacctctgctcagctctgcacgtacatgccccctcgatgtcacctcctgacttggcaagtcatacaccctctctctacttgcccagcttcattcacaaaaccaggtcacattacccctcgtccatccatgctcagtctggaaaccctgggatcccagacaccagcctctccctggccctctgtttccaatcagacggccaccccgactgacgctggggccggggcacccttgggcgttatccagtctccctgtcctccctctcctgccccacgcctccgaccttccccacatggcagtcacagccagacggccaaggtggggcctgctgcttcctgcttctgcctgacaatggccctggattccccattcttcacggtcagtctcaccttcacaccccggctctgagcaacctttctgctctctccactcctctttcatgaccctgggcccctgctggccgccctgcctggaaagccctttctcatttgtctggcttgaaaaacctgcctcagctcaccagggccagctcaagactccctctgttgtcacacgctttctgcactgctatcagaaagaactaacactctccctgtctgtgcactaatccagggtaggtgggctgttttcacacatgcaccccctctaggttctgactcctctggagtgcatgaccatatcttatttgtttccctgtcaccagtgcctaaactatctgatgcatatatttattgcaggtgcttatcacacatgcagtcaatgaacacctcacaaatgcaaggttcacatgcagtcttcgatgaacacatcgatcgcatccagcagtatgtctgtattggaaaagtccttccatagcacccagtaatgaaaaggaatgtggcggggagcagtactggacagtaaaactaaaaacaccaggaagatcacagtgagatcagcagagccctagaatggcaaatccatgacaaagaaaatttctgatgaataaaaacgtgcctgggtccaggccagcaattggcttctttcagacactattgactgcaacaaaccctagcacaaggagagggtctaacgagaaacttgttcagaggatgctgacccatccatcagtgagcacagccaacccaaaaaggcggggacgcggcagagcaggggctgagggcacacttgctgcagtgttcacggagcacacacagaaagatctgcccgagagagtccccaaaaggcacaattctacaaggtcaaccaagtggaggggaatggcagtgaaacgccaaactcctactgaaaggttgatgggtacagccttccagagacagggctgggtggcgggaacgcgggcacccagaggtccagatcagcaaaagaggccagtgactctgtctccatcagataaaattcagccacagcgggagggagcgtgtgagacccacgaaggccttgccctggacctacacctcaccctgttccagagagaattcagtggccggcaacactgccagttcccctttatttcccttgaggtcaacattttggaattttctactcacatccaccgagcgaccctcctcggccacctccacacccacactccaggcccaccactgcccttgggcatgagcaagcctgacgctgtctctcatcctggtaacaccttcttccccgcacacaccgtcaaacacatgcacggtgtagactgaagtcatcaggtctccttaaccaggctgcagtcccctagtaccctgccatgcagccccacagctgccggggggataaacaagcaccttcagactagagcagcttctgagtgatacgcaaagttaactggggcacagagaaaacagaattttcccaagattgctgaaggaaaactaaaaccgaatgaggactgactcatgctcgtttagtcggccacaggctaggggcagcggaaaggccctgctggaaatttccatccagggtctgtgcagggcgggtaccccagagccgcagggcagggcagatggctcctcagatcgggctggagagacatccaggaggaggatgccagttgttgggtgtagctggaccttcctatagacagggagccatgggaagacagagaccactgatgaggaaggggagatgcagcagcagacactccgtccacatgggccccgggccgccagagaccccagggcccacgtggacgtgtgggtgttgaagggtaacacgtagccctttccaaggtgtgttgatgacttggctcagcctgcaaagccaggctgcctgtactgctgcctgacctctggcctctggcctccaagagcctgaccctctgggaagacagagtcccagcatggggcatgaccaccccatctgctcttcctgttcatcagtgtctggacctgagccacagagtcctgctgggccattgtggagaagaacctgctctcagccctcagcagcctccctgccctgccctgcctcccaccccaatctcaacagcctcttgctcttttcttcccgccatctaagctcatttctcctctttgggccttcatacatgggtactgctttgctagaaatctctcaattttacctctctgtgtggtgggacaccagaagaaacaaggttgagtttgggtgctggaatttggaggaacatgtaaacactttttctgctgtagttgtagaggtgcttgaataagaatgttcaggctgggcatggtggctcacacctgtaatcccagcactctgggaggccgagtcaggtggatcacctgaggtcaggagttcgagaccagcctgaccaacgtggagaaaccccgtctctactaaaaatacaaaattagccgggcgcggtggcacatgcctgtaatcccagctacttgggaggccaaggcaggagaatcgcttgagcccaggaggcggaggttgcagtgagccaagatcgtgccattgctctccagcctgggagacaagagggaaactcagtctcaaaaaaaaaaaaaaaaaaaaaaaaagaatgtttaaaaagagttaaaaatgttttccttcttcctattttatcgccctgcctctctttctttgttggagcccatatggaggggacagaagacaaggccttacagctgtacattaggcaggggcaccaggaggaggtccaggcactgatgagaaaggcataaaggcacagttaatgccagctcatatgatccatcgtggctgttgtcccgcctcatgcacagggggtgttggggaagaaacaatctctctggcccagagggatacttagagtgcttcttctatctctagggccttccatggcctcagagcacatgtgtcacaccacagaaagccaacccagcaactcagagagaaatggttttagaaatctaagaagcaagagaaacaaatcctcctgggaaaggagctcatgtgcagtgcctgagtgtgggtctctctacagttctccacttttttctcttccacacgtctctgtcactttcacttgtcatttgtgtatacttttcctacatcagttaaaaaaggttcccaccacccaccaaacccgctgccagaacactcctggacagagaggacacaagcagtcactgctgttttttgcaaattagaaacttggcaggtatcctgtgagtatcaaaggagatcatccacatgacacgtctagcccaatcattgcccttctttccccttgttgcccactaacctgggctcctagccctatccgatcctcggagactgggcctttggtgacccacaaacctcacggccatggagacgaacagttcctccatagctccctatacttcctcactcctgggcacccagggctccttccccagtgagcacggcgtcttgcacacagccggctttcccttatctgcatggcacctgtcactctgtctaccaatttccagcagggaatctgattgcccaccagccaccattcagtctaacaagaactccttggcaattagaggaatttggaacgctccagcaagctcactgaactgatctctttttaagcacccattgttttctctgcagtaatttttttctttcagcagcttttctagcccctatttcttaacatttcctaaaatgaaaatttcatttgtgtttttacttttgatcatttattaacagtctttggcttattctttagaggtttttaaccagcttctttcagtctttcggtagtattaccctgcaatctccttttctttcctgataccatttagcttttctgactttcaattaaaatatccttgctatccactgttgataggttatttatgtagtacttatacctctattaaaggagttaaattttggtttctggttttaaaaaagaaacaatctctctacctgaataatacaagtctctatgcctaagtatatctagaatgaataaaaataccaaattttaaaaaaggaaaaccagcaagattagatagcagtatatccttaaaaggtgtttcaagaacaaaaatcaggtaatattttaaagttactacttcaaaattccacgaagaaaggggcaatcttctgacatacattattaggcattctcccctctccaagcagaaactgagacaaactaggaaaaatgtgatagtgaaataagtgagatgcagctataaataaaagaagaaattgttgggtacagaccttagtctttgctttctgcataagcagtagttttgtggtaggcgtgggtttgggcgtgtaggtcttgggggaaggagcattgtacacattttacagtgttcctgccctcctgagacagctgtggctcttgcttccccaggggtcagggtccatgttcccacctcatgttgtttatttattttgaggccagagtgcagtggcaccatctcagctcactgcaacctctgcctcccaggttcaagtgattctcgtgcctcagcctcccaagtagctgggattacaggcgtgcaccaccacgcccgcctaattttttgcatttttagtagatacggggtttcaccacgttggccaggccggtatcggactcctgacctcaagtgatctgcctgcctcggcctctgaaagtgctgggattacaggcgatgttcccacctgatgttctatcatttcaaagaatgcactgaatattgggggacttcagggactgtcacttttgctttaaaaactgtaaagtgaatctaggaaaagctttttttttttctggtttctccaccatcagtttgcatgagaaacgccaatcataggactgctgggaatggccccttagctgtgctgtttctgagccaggcctacatcctccactggcttccttgggcgaattttaaggcctatgagcactggagttgtgcatggaggtgggggccaacaggaagtccattgtcctaaatagtcatttcagcctaactaaccccatggtgaggctgctcattaacaggcaaggcatcactgtaaaccttgcatttgcatttacacctactatttattaagtgccacagccatctcttatcatgaccggtcactgagcaaaccctacatttcaaaaacaatccagtttataggtcctctgtctgtttctccgggctggaaaaggctttccatttatcaacttagttgtccccccagtcgcctcttgcagggaacagggccagatcagatggcggctggttcccctcccccgcctcatacaaaaatcaggaaaaggagttgcgggaggaatcgagaagccggccgcagagcccaggtcccccatggctactgtgaggcattcgccgctgcaaatttcctgtccactgtgggaagcggcacacctcactcatgagcagacgacaggactggcacgttttaatggagcacacgggcgcagcctaggcggccttttgctccggctgagaggcacgggcccggtgccagcatttgacagtcctgggaggcgacgggtagaggagagacgcggcagccgcggggccggggagacggtgggaggcccggcgtccatcatccactttattacttgatcaaactttaacattttcgggtttcctaacaccttagccccaaatactcgaaatgaagcaaatcttaaattaaggagtctttccccaccacgctctgtcctcctccccacttcaccctcccgccgtttcgcgttatttccaaggcaatttaaaaaatcaagccaaacaaagctccccggttgctgccgggcgcgcgcggcgaacgaagcacatttcagttcagcaccagcctcggggacagacgccatcaaggaggtgaggaaaaccaccctcagctgcggtggctccagcgtcaccccgagtgctcccgaggcggcgtctgggctgctggggagccaggagggcttcctcaggcactcgccagaaacatttccccaaagaaaacgcccaaccagccacgccatctcctgccactgaggtccttttccacgggggacgtccccgctgggaaaacagcaaacgctctgtgacctacaaatggaagaggggacccccgagcccccgcctgcctcatgccggagggaccgggcgcccccagccccggaagcccctggacgcgctccgagggggctgtccacacccgcgcgcgggcttccccggggcccggcgggaggtcccgggagaggaggccgagggaaccacaggtctttgtgtcgcgtgcagcagcagctggcggcgtgaggaccacaccggcgccagagccgtctccctaggtccggagactttcaccccgagtttcccttccgcgtctggctgcaccgggctgggctctccccgcggacacccggggctccggccgggcgcccacttacccggagcgggatcacgcgcgggcttcgtctgcagcgcggtgctcgcggggggcggccaggccgagcggcatcgctccgcatcggggcgcgggccgggctcgggtgcaaacgcgcgcctcgtgcccctcccgccgcccgcggggtctccgcgtcccgtcaccggccccgccccgcgccgcgcctcccgccctgcagggcccgaccacgcgggcctgggggcgcaggcggaccctcccccggccctggacgctgggggcttctgctcggccccctgtgccgtgggggcccagactggggaagggagagccggcgactctgcgaccctcgccccc

SEQ ID NO: 887 - DNA, 103071 bp, Homo sapiens; identical to SEQ ID NO: 885

SEQ ID NO: 888 - DNA, 57250 bp, Homo sapiens
tattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaatgattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaagagtacttaaattaatcacatgcttttccctacaattatacctaagctgagtatatcttcttctgtgataaccagctttgattgaaatgtactcatattaggtaaacattaggcaatgataggaggaaagcaaaactaattctttcaaaatgtcaacaaaatttagaaatatccttcccgatggcactaaaaccctgagaggtatttgcttttattcatactcacacaactttagcatttaaaaactatgagtactaaactgtgaccttcaggatttatgttagatggcagaaagaaaatttgggtattagtctaccatataaatgaacttctttaaaaccaaggttcagaactgagaatcatattggttcctcttcaagttagttcaagttgcccacttcagagatccacaaaatctgacattatttccagaaaccccaaactttggtataagtgaccactgctcaaatatgtgatcacatgatcacacagcattcctgtgagttcctttttgtctgataattatcctaattagctctacagagctatcctgcaatccaggttgaaattcaaactctcagttactactacagatttctgaactaggccaagttttaaccaaaaactataggtaatggtgaattactaattagccacaatgcatcaggatttagaaatattttttcttttataaaataacttggtatttttctgataatcttccaatagataaataaaaacttttcttatgctacagtacaagttgatttttaaggaaatttgtgcaaacattaagaaacaccgcattggttctgggtgaaagtgccagtctggaactctcttgaaagaccatacagtctactgctaaaccctgggactcctcagacttgcactcagattatcgtttgcctgccctgattttagactctgctaattcaagtccctgttatcttgcttgacatcgacaaggatcaccgcaccgttccttcagtttccacagttccgtcagttcccacggagaatactgaggagaagacagcattcctgtctcacaggtcttctcacacagccacagactgtcctgttgagaaacaaccaaagccgatctgagagtggtgaaactgttttaagagcatcagaaagtatgcacgtagacagcttttatgtattctaatgatgctgaaattatttcaaggataactccgtgtgtggaacaactggtgaggtttgggggtggcacctcctgatttgggaaagcaccaggtcccacagtcctgtggctgtggaatacagaaacaaggcggtgtgtggatgaagagttagtcaacaaatgccattccgtaatgaacgattttagaaaccacaagtgagtttcatgtttgctagtaaaggtgtgtctatggcagtattagtaacagctattattctgatggaatgcttacaatattgcagggactgtaccaagtgctttgtaaatatctcacttaaatctcacagtaatgctgtgaggtaggaactatttccctcttaacaattgaggaacaaacgaagagttaaaaaacttgttccaggtcacagggctggtaaatgaagaggagggattaaagactcccaagctcaagttcttaaccactagactatttcctagctacgtgaattggtttctatttccagcaatgtagcagaacacagagagaaactcattcaatgttttgacaacacaaaaatgttggataaaattaaaaacctttataaagcatggctcaactccgtgatcaaagaagaaacagggtaggagaaagcgctgagtcagcctgtgccttgaaggcagctgctgatccttgggtttggaaggccaagcccagggtcaggagactaatgggagactgacacagagctaggatctctgaggggccacagcctcaggggtgataaaacaaaacacactcagcttgtctgtctcagtcttgcccctcagtgggatggaaaggagtctctctcccctcagtgcctacccacagcttgcacttaggtaggtctggggctggtagtcagtctgtgtaagcccaacagttccaagccaaaaatctgaagtattcatagatggtagtattcctagatgcatggcagaaaaaaatgtaaatatgtaaatcctctctgtaggaatgcattttaaatagaggactcagtttccaaagacatgagatggtcacaaaaaaaaaaaaaaaaaaagaccgcatcagaaaacaagcgccatgaacaacagttgtagaaacaacaaactgcaaaatcagacccagcaaagactacagatcccagaattaccagatacaaaaaagaattatattcaaagatgagacaaagtacagcaaaggaatcagactatcaaagtggaccatgtagatgtgggttgatttcttgtcctggactgagagctgctctgggaccccagctctatgcagggcttctaactgacagacactgcatgtgccttctgtcccctgcaccttcgatggccaaagtggaagctgcaagaatccagaacagaaatctctgaagctaaagccagctttgtgcttgatttcttcccagggctctagtttccattttggtctctgcagattcatttttttttctggttcagcaatactgtgttttaaatgatgtcttatatttcatgcagtgtcttatttttatcggtcagaagggttgaaggatccttagactgccacactcaatcagtggattctgtcgttcagttttttttttgagacggagtctcgctctgtcgcccaggctggagtacagtggtgtgatcttggctcactgcaagctctgccccccgggttcatgccattctcctgcctcagccttctgagtagctgggaccacaggcgcccgccactatgcctggctaattttttttgtatttttagtagagatggggtttcaccgtgttagccaggatggtctccatctcctgacctcatgatctgcccgcctcggccttctgttgttaagttttaaagctgcaaataatttctgatcaaatctatggaaactgagtttttttgtaggcaggggaacgttgatttataaccttttgctttaaactcagaaaaatactgtatgagaaataacctagtggattattgtgaattaaagcaacagcataactattatggtagaagatcctcattctttctgcccatggtgtgataaacattacaggttgagcattccaaatctgaaaatttgaaatccaaaatgctccaaaatccaaaacttttttttttttttgagacagggtctctctcactctgttgcccaggtgggagtgcagtggtgcattcacagctccctgcaccctcgacctcccaggctcaagttgatcctcctaccttagcctcctgagtagctgggaccacaggcaggcgctgccatgcccagctaatttttttgtagtttttgtagagacggggggtttcaccatgttgcccaggctggtcttgaactcctgggctcaagtgatacacccaccttggcctcccaaagtgttgggattacaggcatgtgccactatgcccagcccaaaactttttgagagccaacatgacactcaaaggaaatgctcactgaagcatttcagattttcagatttggaatgtgcaacttctaagtataatgcaattattctaaaatccaaaaaaatctgaaatcctaaatacttctggtcccaggcattttggataaagaacactcaacctgtatatagaaatccacctcctcaactcttaagaaccctgaggccatccccaaagacttacctggtatcttttaggtcctatggcagccatccagatgcccatgcttacatcttcaccctatacatggcccataaagtttaaatgtaaaaattttaatgctattttatttgtaaagacaaaaccatagccactcccatcataaaccacctttctacttttttgctctgttattattctaatatgaaatagcaaaaatgggttcacatgaagtcaaagctagtggtctttaatatgaagcacccctgccacaaggtaataagatgaaaccgcgagcagacgacccatccttctcatgtaccttaagcttccaggaagcacttagggcttcctccttaggaataaaaatctttctattcctccagggactatactttttttttttttgagacagagtgtccctctgtcgcccaggctggcatgcagtggcgcaatctcagctcactgcaaactccgcctccgggttcacatgattctcctcctcagcctcccaagtagttgggaatataggtgtgcgcccagctaattttttgtatttttagtagagatagggttctgccatgttggccaggctggttttgaactcctaacctcacgtgatctgcctgccttggcgtccgaaagtgctacaattacaggcatgagccacagtgcccagcctccagggatgacacctgtaaatactagctgaaaacataataagtaggctcaaaaaagatttaggaatagaatttaaaggcaagatttgagggatgtaggggtgcatccttaacctttgagaggtgattcctatacagagaataacgtgcttttccccaaggtaagtgggttctgctttccatgatgggatgccgagtgagatgaaacttggtgtgatgagtgtatacgtaggtgggaaatccttaattttttgtttttattttattttttattatagagatggggtcttgctatgttacccaggctggtcttgaattcctgggctcaagtgatctacccgccttagcctcccaaagtgttgtgattactggcaagagccaccacgccaagctaagaaattcttaattacctgataggtctttaacctccccgagttgcttgccagccacttgacgatgtccttggagatcacatatcctgacccacatgcaaaggcagggtaagcggggctcgggtactccaactcctgccactttccggttcggtcaactgcccaattcagtctgaaactgagatgaaaaataatgtggcctcttgtgttagtctgacacatatcctgccactattaaaacttgactcctttatcatcactacaaaggaataagcttgtagaagtgaggaaagaaaataagaaaatttctttttttttgagatggagttttgctcttgttgctcaggctggagtgtagtggtgccatctcggctcactgcaacctctgcctcctgggttcaagcaattctcctgcctcagcctcccgagtagctgggattacaggcgcacaccatcatgaccagctaattttttatatttttagtagagacagggttttgccatgttgtccaggctggtcttgaactcctgactttgggtgatccaccctcctcagcctcccaaagtgctgggattacaggcgtgagccactgcccttccagaaaaaaattttcttaatctaaggaaaggaattatcatttatccagtgttgttttagataaaagattggttatgttaaattttctcaaagttgcatttgtagagtttctgaatgaaaagcactagaagatcaccctgtgttttagtatatatgaaaacaaaaaaccaaatcactaatccatattgtattcctgaggaagcacagaaaatggtttcagagacgtgtcacaaacgtactctaacaaaatatacagtagcttctaatgtgaataccatttatttctttggcataagaataaaagccatattgttttccctcctttactacattagcctgaggcttttcatttaaaaaataatttcctccaattgtacagtaatataaaatttattattattattaagacagggtctccctctgttgcccaggctggagtgcagttgcaaaatcatagctcactgcagcctccaactcctgggctcaagcagtctccctgcctcagcctctcaagtagctaagggctacaggctcacatcacctttttaattttttgtagggacagggtcttgcaacgttgcccaggctagttttgaactcttggcctcaaaggatcctcccacctcagccttcccaaaactctgggatgacagatgtgagccagcatgactgacctagagtaatgaaatatatataaacccaggagtctagtacgaaattgtatatctcaaccacattttcaaaaaaaaaagatattttatgctttattaattacatttgatcaggtacacgaatgccaatgggctaagaatggttaacttactttccccaccaaaaattaggcccatccagattcttttggacaatcctattaaatacagcttcgaggtctatgtaacagtcatcatctgtcttcagcaacaaattgaagctcgttgtttccacagtcctgttgacacaaaagggataagaaagtcagtgcgaccaaacaaacaaacaccaatgcagtggcgtcactaacactttcattcaaaactgtacctgtcattatctaaatttcttattcctcaaatgttgagaacatttgctctaacaaaattttgctgctatcaactaaggccatcacttggtctttactaaatggcataacacagagaagtactaacctgattttaaaaggcaaagaaagagcatattgaaggaaaatatctggcttaaatggaacatatgttcaaacaaatgcttcttaggcatcattcaactcctgctgccaaatctattaaacgcctgaaccttgccccgtgtgttcttaataacaaaggcccagcataatgaattaggtgttacatctgggcctctcacacagaacgctattgtacaagatgcatccgatgctatttatattacactcaaaatattttatggcttaaaaaaacctgacttattacattgaaacatattttcccttggaaacaacttctagcaattaaaccattataaatgaccttctggaaggcaaaggatagtgacttcattatctagacgtaaaatatataatcatgactaaagacaaaattgactccttcatttcacattgacagtccctgtacatctgtttaaaaatgcagttttgctagggtgccagtcatatgtcagaaatctcaataaaataaatttagaatttcattaggtccaagaatggtgaatttaacaataatgggtccacaccaaatagcatcaccccatgtttctaaagtttatttccaattaacagcagaaggcatacataatatttgctaattagaaatttcatgataaagaatatttaggtcactgataactgaaataatgaggaagaaataatgaaactcatttgtagtgtggagatgggtgatgccagctatggggacgcaggtcccagatcagagtcctgttgaaggttactgcagcgatccagggagagaaggtggcagccaacaatagcggcagcggagactaagggagaggctaagatacttccacgcctaggaaatatcttgctctaaagagtatccggggctgactcttagccctgacttcccacccttgggacttccatgcccattcctcatctcagcctcacctacaattgcaactctcatttgcggccccaaattaaaaggaggttctttttcttactacagctgcctaaacttaacctagtattcgacacacccagatttccaaccctcatttacctctgctctctactcacaggatgagtcccaaattatattaatttgccccagcaggccaggtgtggtggctcacgcctataatcccagcactttgggaggccaaggcaggaagactgcttgagacctcatttctattaaaaaataaataaataaataaataaataatttgccccagctaagaaacattaccttccataaaccaattagaccatctacccctcaggaccagggaactgtatccgtaaagtactgttcttggtaacttcccactctgcctagggcaacagagaagaaaagaaagagacagaccctgggcctcacaccaaggaacagaagaaggtttttaaaaataaaagtgaaaaaaataaaaagtgaataccctttataggtttggcctaatcagagataggtttgaaagttttggctccatggtcaggacagacagtaccaggaaactcaacataaaattttgagatcctagagtaactaataattctaataactatacgttaagattatatagatatataatatgtatgttactattattatatattgttgctgttattcttgttataaaagtaggaattaaaagtaagttccaagaaacactggagggtctgggaaattataaatatgatagattctgggagttgtggaattttagtaagccagccacgtaagagttttagaatcagggaggtagtttttaaacggatggagtagagactggaagtataaagtggatattcagtagaagagaatgcctatcagtaacctaaatgtgagtgactataactggggaatctgggtaggtgggtataaatacaactaaaaatggaccattcccaaactcactgatttttatctaatgctggcttgagacaaccgaggcaagcagaaatgactcaaaatgaatcaactttttttttttttttctttttttttgagacggagtctcactctgctgcccaggctggagtgcagtggtgtgatcttggctcactgcaacctccgccttctgggttcaagtgattttcatgcctcagcccccctgagtggctggcattataggcgctcgccaccacacttggctaatttttgtatttttagtagaaacagggtttcaccatgttggccaggctggtctcagactccagatctcaagtgatctgcctgccttggcttcccaaagtgctgccggcaggcataagccaccagccaatttttgccgtgtttttgataggttaatatcacattgtggatctttatcaaaataaagtggcagcatcttagaagctcagttttcgcaaggaactgggatacaataggtcatatcccaggtgctcagtgtccttaggtttgtttttatttgctgaaatctcagtggtttgaagttgataaattgtctcgatagcaaaagaacaataaggcacagtgtcatgtgcctgtaatcttacctactcaggaggctaaggcaggaggtttgcctgcactcaggagttcaagaccagcctaggaaacccctagtaaggggtttccttacagcctagtaagaccccatctcaaaaaaaaaaaaactaacaataaaacaagttctagctacccaacatttttacaacctaccatctatagaagttcaataattttgcaggaacattacgataagtgtcgacaacatccacaaaaacaatatcatcatagatgctgctttcctccttcagtaaggcatcttcctcatggagattccttatatgatcaataagtctttgagggcgagaatgaaggttgtgtaagagagcatcaccttctataaaggaaaagttgagagttggagaaaaatgctgttgtaaagttaccattcagaactgatgatgtacactaaagttcttttcccaaggtaacccagcagaaacacatgcagttgtttggaactttaggtagaaaaatgggaactctcatacactgccagtaggattaagtggatgctcccactctggaaagcaatttggcaatatctatttaggctgaaaatgtgtacaccttatggttcagttgaggccacttgtagatatatccctactaacattatttcacatgaggatattaattacagcattgtttgtaattgtggaagaaaaatgggaccaacctaaatgtccactgagagaaaaaaaaaaaacagccaagttgtggtatattcacataatgaaatatagcagttaaaaaaattaccctgatcttgcatgttaaaaggattgggatgaaaaaataaagttgagtgaaaattgccaagtgataaatacaatatgacaccacagatatcaattataaaacactcaaaactatgttatttaaagacatggtcaggcgtggtggcttatgcctgtaatcccagcactccgtgaagccgagggaggagaatcgcttaagcccaggagtttgagatcactctaggttatatagggagaccccatctctaaataaaatttaaaaattagccaggcatagtggtgcatgcctctggtcccagcttcttgggaggccaaggcaggaggatccctggagcccaggagttcaaggctgcagtgagctatgattacaccactgaactccatccagcctaggcaacacagcgagaccctgtctcaaataaataaataaataaagagacgtaaatatgttcaaagtagaaaaataagaatgggaagggtacacatgaattttagggaagtggcaccccctttgaggagagggaagaggaatacatctagggagaaccacaaggaaaaggtttcaactgtacctacaatgttttcttttttttctttttttgagacagagtctcactctgttgcccaggctggagtgcaatggcatgatcttggctcactgcaacctccacctcccagattcaagtgattctcctgcctcagcctcccgagtagctgggattacaggtgttagctaccacgcccggctaatttttgtatttttagtagagacggagtttcaccatgttggccagctggtctcgaactcctgacctcaaatgatccacctgcctcagcctcccaaagtgctgggattacaggcgtgagccactgcaccaggcatataatgttttctttctttcctctctttttcttttttgtttttgagacacagtctcactctgttgcacagactggagtacaatggcacgatctcagctcactgtaatctccacctcccgggttcaagcattctcctgtctcagcctccctcatgagtagctgggattacaggcgcctgccactgtgcccagctaattgtttgtatttttacaaacaattgtaaaaattgtttgtaacaagaggcagggttttgccatgttggccaggctggtctcgaactcctaacctcaggtgatccacctgcctcagcctcccaaagtgctaagattacaggcatgagcgactgtgcctggccatgttttatttaaaaaaaaaaaaaaaaaattagaaatgaataagaaaaaatgtaaataaaaaattgttaattctgagcactgggtacctggctgtttctgtactatttctggtgtatttatgattatttcctttgtttttttttttttgagacagggtcttgttctatcacccgggctagaatgcagtggtgtaattatagcttactgcagcctcaacttcctgggctcaagtgatcctcccacctcagcttcccaagtagctggtactcccggcacctgtcaccatacccaggaaattttcaagttttttgtagagatggggtctcgctatgttgtccaggctggtctctaaatcctgggctcaagagatcctcttgcctcccaagtttctgggagcctcccaaagttctgggactacaggcgagagccactatgcctggccatgatatttcataataaaaatgattactaatgtgcttaaaagacaatttatttgccacttcacaagttaatgagtcacttgtcacgtgtgcagggactgtccccagatcctactgatttaaggcaattctttcgctgtggcaggagacgtcaggatttcctaaaaatgtctcaatcaaattaaagaaaaattttgaaaaatacaaagaaaatgagctgctgagggtggcaaaggaaatgaaatacaatttagcactgcactctttgtcactgcaaatggaaaggatgaggtgggaagctgaaggcctatatctgacttctgcctctcatgacttgtgagatactggacaagttctgttgtctctagaccacagcagtctcacctgtagaaaatggtgctggattcaatcagtgattcttgggaatgcttgctgaaatgcagattcctgggccccaagcctaaagattcagtaggtctggggtggagcccaggaatctattttttttccttctgcacctgctcccaggaatctatatttttaatggccactgctgcgaccctgatgcaggtaggcagaacacagaccagcctttgagaaacacaggggtagatgacctcctgtttttttttttttttttttttttttttttgagatggagtctcactctgtcacccaggctggagtgcagtagcgctatctcggctcactgcaacctctgcctcccaggttcaagcgattctcctacctgagcctctcgagtagctaggattacaggcgtgcgccaccatgcctagctaatttttgtatttttagtatagatggggtttcaccatgttggtctggctggtctcgaactcctgacctcgtgatccacctgccttggcctcccaaagtgctgggattacaggcattgagctactgcacctggcctgacctcctgtttagacttacaatttttggactttacgataatgtaaaaacaatatgtgttcaccagaaaccatgctttgagtacatatgcaaccattctgtttctcatgtgactacagtcttgtgagatgttcaacctttattatggaataggctttgtgttagattattttgcccaactgtgggctaatgtaagtgtcctgagcaagtttaaggtaggtgaggctaagctataacattcggcaggctaagtgtatgaaatgcattttcaacatacatttttaacttaacatgggttcaacaggatgtaacattgtaagtcaaggagcatctgtataatttaacacttgatggaaagtgaaagtgttataaaattgtaacaggaaaatggcttgtaacaacaggagtgcagaaattaaatacaagccttttagactagtaacacattttgtttcactgcatgtatctgaaaaatatgagcataaattaatatgtcaggaaaatgaaaggatgtctgcttttgccacttctattcaacatacatgttctagccaggacaatcagataagaaaaaaggcatccagattgaaaaggaagaagcaaaactctctcttcttacagatgaaatgaccttgcatgtagaaaatcataaggtctaactttaaaatgattaagtaataaatacatggatctgttcagcaatgttgcagcacacagatcaatcacaaaaacaatctgtatgtctatatactcgcaatgaacaatcttaaaattaaattagaaaaacaattccacttacaacagcatcaaaaagataacataagtatttaataatttaacaaaagaagtgcaagacttttatactgaaaaatcaaacatcattgaaggaaatttaataagacatggatgttcaaagacttaatactgttaacacggcaatactccccaggttgatccacagatagaatgcaatccctgatgggaatgtgaactagtacaaccactatggaaaacagtgtggagattccttgaagaactaaaggtagatctaccatttgatccagcgatcccattaggaaagtaagtcattatatgaaaaagatacttgcacatgcatgtttatagcagcacaatttgcaactgcaaaaatatggaaccagcccaaatgcccatcaatcaatgagtaaagaaaatgtggtatatatatatataccatggagtactactcagccataaaaagaaacaaaataatggcattcacagcacctgcgtgcagctggaggccattattctaagtaaagtaactcaggaatggaaatccaaacatcgtatgttctcactcataagtgggagctaagctatgaggatgcaaaggcataagaatgatacaatggactttggggacttggtggggacagggtgggagggggtaggaataagactacacactggttacagtgtacactgcttgggtgatgggtgcaccaaaatctcagaaatcaccgctaaagaacttattcatgtaatcaaacaccacctgctcccccaaaaccgattgaaattatatatttattcatatatatgcatatatatatatgcaatcccttaaaacattccagctaggttttcttttttttttttgcacaaattaacaagctgatcataaaattcatatggaagtgcaagagacccagaatagccaatcaagcttgaaaaagaacaaggttggaggattcacatttcctaatttcttttttttttttttttttttttgagacggagtcttgctgtcacccaggatgaaatgcagtggcaatctcagctcaatgcaacctctgcctcccaggttcaagcgattcttctgcctcagcctctggagtagctgggattacaggcgcccgacaccatgcctggctaatttttttgtatttttagtagagacagggtttcaccatgttggtcaggctggtctcgaactcctgacctcgtgatccacctgcctcgggctcccaaagtgctgggattacaggagtgagccaccgtgcccagcctcccaatttcaaatcttactaaaaagctacataatcaagacagtgtagtactggttaaagacgcagacacatagatcaatggaatagaattgagagtcctcaagtaaatccttacatctacagtcactgattttcaacaaatgggtgctgggacaactggatatccacatgcaaaagaatgaagttaaacctctatttcatgccatatatgaaaatgaacatggatccaagacctacgtataagtgctaaaactataaaactcttggaactgtaaaacaaaggcacaaatctttgtgacctcacattagacaatagttccttacatatgacagcaaaaacatgtgacaaaattggacttcatcaaaatttacaacttttgtgtgttaaagggcaccatttgcaaagcatgtatctgataagggacttgtatccagcatatataaagaactcttacaattcaacaataacaaaataattttataaatgggcaaaggatctgaatagatatttctctaaagatatacaaatgactctctctcccctcctttcctcccttcttccctccacccctccctccctcaccaccttctccctctctccaccccttcctccctcacttcctccccctcctccctccctcacttcccacatctagctcatataccataataattcaccctgttaacagtgtgcagcctcagcaatatgacaaaaccctgtctctacaaaacatttaataattagctgggcatggtggcatgcacttgtagtcccagctattcgggaggctgaaatgggaagttcacttgagcccggggaggtcaaggctacagtgagctgtgatcatgccactgcactccagcctgggcaacagagtgaggcctcgtctcagaaaaaaagaaaaacaacgaaacaaaaaaggaagatatacaaatggccaataagcacatgaagaaaatgctcaacatcattagttattatggaaatacgaataaaaatcacaatgaaataacaatttacacccactaggattggtatattttaaaagacagacaatttattaagtgttgacaagaatatggagaaactagaatcctcatatactgactatggaaatgtaaagtgggctgctgctttagaaaacaacctggcagtgcctcaagtgattaaacacacaattatatgacccaggtcttctactcctagacatttaagagaaatggaaatatatgaccacacaaaaacttgtacctacatgtttactacagaattattcatattcaaaaagtagaagcaatctaaatgtccatccattaatgaatgaataaaatagggcatatcgatgcaatagaatattatatgatcataaaaaagaagtactgatacatacaaaatggacagacctggaacacatgttacagcaaagaaactgacacacagagtacgtactgtgcatttccatttatgtgaaatgttcaaaacaggcaaatccatagagaaagaaagtgcatcagtagttgttagggggtggggggttggggaggtaagaatgaggagtaactgctaatgggtgtggggtttccttttgggaggtggagccggttgtagaactctaagaatacactaaaaccactgaaccactttaaaagggtgaattttatctgaataaagttttttaaaagacaaaaaagaaaaaatccttttctctcaagtataaagattaagtgtaagacattcagtgtacttttcaagtttcaactagcaaacttaccctgaatagtatatataaaaccacctgcaactccctccacaccttccaagaattcatgaggcaatgcaccctccccagcctgaaaggaataagaatgtactcagtgattcattactaaaaatacactgatcatattttaaaatcgatttgacaaaaatcataatatgactccacttgcagcagataaatgcatgtaagatgctggtgcactggaggcttataatatcaggatgacatacggtattctactatttttgttatctaattacaatactaaagataagatatacccaacattccataaggtgttcagaattgcaacttacatagaatcatgtttatgtacttgctactctagtagtacaaaaagcaattgattttacatcccaaccccaccacttaaaaaaatatgtattacgacctttgattttttggaaactaaaaattctcatgagttcaaatacatcttggcatgctttaaagttaagagaccatgcagagaaaggctcaaaattaacagtctgttccaaatattcaaattgaactctactgtatattgattaaaaaaaaatttttttttaatttttaatttttcttttttttttttttcaaataagagacagtgtttcaccatattggtcaggctggtctcgaactcctgacctcaggtgatccgcctgcctcagcctcccacagtgctgggattacaggcgtgagccaccacacccggcctaatttcattttacagacagggtttcactctgatgctcaggctgagtgcagtggtgcaatgatatctcattctagccttgaacatacaatcttcccatctcagccttacaagcagctggcactacaggtgtgcaccaccatgcccagctaatatttataaattttttgtagagaagaggtctcactgtgctgcccaggctggtcttgaactcctgggctcaagtgatcctcccgcctcggtctcccaaagtgctgggattacaggtgtgggccactgtgcccagcctgttgatgttgttgaaggtgcttaagcctattgtgccagcagccaatgacagtcctttctacttcttagaatggagaatcttttattattaaagagttatctctcttcaaaagttacccaatggccttactcagagtgaactgttttacttctgtatacagtaaaccactatggtacatctaccagagtattgtctggctgttgtgggctagatcagacagttaagagtccatactcagtgtatttacagtattttttctacaccttcatttaatcaagagagctactgcttggctattcttaaacagatcttttcagagttgtactgtacaaagcaatgttttaaggccagtagaagaagtaatctgaggtcactgtagtaacttgtcatttaatttaaaatatgtttgtaggccaggcgcagtggctcacacctgtaatcccagcactttgggaggcggaggcgggcggatcacgaggacaagacatcaagaccatcctagctaatacggtgaaaccctgtctctactaaaaatacagaaaaattagctaggcatggtggtgtgtgcctataatcccagctactctggaggctgaggcaggagtatcacttgaacctgggagaaggagattgcagtgagccaagactgtgccactgtactccagcctgggtgacagagtgagactccatctcaaaaaaataaataaaataaaataaaataaaagttcgtagccaaatgtgaaaattactaaaggggcaggctatagattccaacgttgtagttccataaaagactgtatatgctttatttgttatttacttatttactttttttttttttttttgagacgaagtcttgctcttgtcccccaggctggagtgcgatggcgtgatttcggctcactgcaacatctgcctcgggggttcaagcgattctcttgcctcagcctctcaagtagctgacagtcgcctgccagcacacctggctaatttttgtatttttagtagagacggggtttcaccatgttggccaggctggtctcgaactcctgacctcaggtgatccgcctgtctcggcctcctaaagtgctgggattacaggtgtgagccaccgcgcccggcctacttatttagttttttgagatggagtttcactcttgtcgcccaggctggagtgcaatggcgtgatcttggctcactgcaacctctgcctcccgggttcaagtgattctcctttctcagcctcttgagtagctgggattacgggcattagccatcacgcctggctaatttttatatttttagtagagacggggtttcaccatgttggtcaggctggtctcgaactcctgacttcaggtgatctgcccaactcagcctcccaaaatgctgggattacaggcgtgagccacagcacccagcctatgctttattttttattgtatatttctatattgttttggctttagaactcaatagtaatttctgtttattaacttctctctaaaaggtcacaacttggctttttgcctttaaaatttttctgacatcacttgctggcaagggaataaagcttagtgaaaactctcagctgtacgcatttgtgatgaaaatcttaatttgtacctggggtttcttagcgtaggctttaaaaagttacctggttttgtttttgtttttttaggttaactgtatgtttaagctatctttagccctctataataatttttactcccaaaggcagatcatttgagtctttacatttgaacctagttctcaactcagaaacctaccttttttttttttttttttttgcgacggagtctcgcactgtagccaggctggagtgcagtggcgcgatcttggctcactgcaacctccacctcctgggttcaagcaattctcctgcctcagccttccgagtagctgggactacaggcacccgccaccacagccagctaatttttgtatttttagtagagacggggtttcaccatgttggccaggctggtcttgatctcttgacctcgtgatcctcccacctcagcctcccgaagtgctgggattacggcgtgagccaccgcgcccggccaatttatttcttttagtgtaaccaatattatagaattttggcatatgctgggtattttaaagtttcataaatagaaaaggaggcaagataataaggaaagatataattccataaaactttctattttcagtaaaaaatttttcataagacttaaaatgaactttagtaaacaagtggtgtgtgtgtttactaaagtaaacaccatctttattgtcctccatttactttatgaaatttacctgtcataataaatcctaaatcctaaacatgaatgaaatcctaaacatggcctacaaatctaaatgtataactacatatgaatctatgggtctatttgtttaatgtctttcttcctcactggactgtaagttccacggtgggccactagtatgtctattttaccctgccattgtttctgccttaccacaggtatgcaggaaatgttttttgaatgagtaataacgtagcatatattcatttcaactcagaaattaatccatgtaaatgaggttaatattcattcactaagcttgtgaatttaaatgccaagtacattcctaatcattggacaggagatcgaggagaataaaagattgtctatgattccaccgtacagaccgtttgtttactaaagttcattttaagtcttcatatacctgctttattgacctatatttactttgagaaattcacctgtcaaactgttttaaatttaaagcaaagccgaatgagaaatatgagagtcagaaatcccagagttgcttcagcaaaataaatgaaagtactcaatcttattttctatttttttttgttttgttttgagatggagtctcgctctgttgcccaggttggagtgcagtggcatgatcctggctcactgcaacctccacctctggggttcaagcaatcctcccacctcagcctcccaagtagctaggattacaggcatgcaccaccaggcccagctaattttttttttttttggatttttagtagaaacggggtttcaccatgttggccaggctggtcttgacctcctgacctccagtggtccacccaccttagcctcccaaagtgctcggattacaggcataagccagcacaccccgccttattttccaatatttttatctatagtagttttttttgtttgtttgttttttttgagacagagtctcactctgccacccaggctggagtgcagtggtgtgatctcagctcactggaacttctgcctcctaggttcaagcaattctcatgcctcagccacctgagtagctgggattccaggcatgcgccaccatgcctggctaagtttttgtatttttagtacagatggggtcttgctatgttgcccaggctggtgttaaactcctggcctcaagtgatccacctgcctcagcctcctaaagttctgggattattggcatgagccaccgcacctggctaattatagtattttaactgaggttttattttcaaggtgagatagtaaatactctgaatactactgagcaagtattcttaaagaatgctaacttaaaaattactgagaaataggccaggtgcagtggctcatgcctgtaatacagcactttgggaagcgtaggtgggcggatcacttgagcccagaagtttgcaaccagcctaggcaacatggtgaaaccccatctctacaaaaaacacaaaaagttagctgggtgtagtggtgcgcacctgtagccccagctacatgggaggattgtttaagccaggaggtggaggctgcagtgagctgtgatcgtgctagtgcaccccagcctgtgcaacaaagtgagaccctctcaaaaaaaaaaaaaaaaaagagaaataaaatattgcattttaaaaatgcatcaatcttaaagcaaaactgtaaactcactaatgctggagttacaggatcatatttgagtttttgcctttactatgaagacaacaacatttgctactatatatgttgtaaaacacacaagaatcattgctccatgctgcctgggctctaaggtaaattttagaacaattttatatattaaaaagaagctaaaatatgcaattaaaccttaaaaaaaaacgacttactgtaatgactctgagaactccccctccatcattcactgtcactttgtggagatttcttgacacaaggccgtggaggtcttggctctcccacacgattgtaccttcaaagctcttttgtagaaagatgaatagtgagtcaatttccttattgctgtcatttaggttttaagtatgctttcaggcaagatttttagagaaaatttttcccaaaacgtatcatttaaaattttcaccccataactctgacataccactgttagcgtttggtgtgtatccttgaccgttttttccatgcacatataaaaaaccaattacaaagagtatatacacaattttgcatactgctgtttgccatttcccattgtatcaaaagcatttccttatgttgttgcagctgtcacagccattcttcctcatgtgtgtataacatcccaatgagcagatacaccctgatttactcattttcccctactattagacatttggttgctactaaatgtctactaaaatatctactaagtatctactaaaataatgtaggcatgttttggtgtacatgtttatttactcctaacaatttgttttgtacttacattcccagagtgaaattactgggacaagaaagagatatttttatggattttggtatacaccgccaactgctttttgaaagcaacttttactaatttatagggttatcagcaatgtatgagaatgacaactgcactgtattctccctggtatgggatactagtaaacaaaagtttaacctaatatactagatttttacaaaatgattccttatttagttggatttatttttcagtttttgacacagagcctcgctctgccacccaggctggagtgcaatggtgcgatcatggctcactgcaaccttcactctccaggtttaagcgattctcttgcttcagcctcccgcgtagctgggattacaggcgctcactatcacgcccggttaatttttggatatttagtagagacagggtttcgccatgttggccaggctggtctggaactcctgacctcaagtgatctgcccaccctggcctcccaaagtgctgggattacaggcatgagccacggcgccctgcctgaatttaaaaaaaaaaaaaaaagattggcttagttggatttctgattcctagtgatgtttatgaattgcatgttctcttctgaggactgccttatcatgctgctttgccatctgccctctgagttttctatttttcttgttcatctatgcaagcttttaataaagtaattatcttaatcctgtgcacattttatatgctaaaatagtttttcatttgctacttaatgctatttttgaaattcagaagtccataaatttcaccttggcaaatctgacaaacttttcctttgtgattattactattaaattctgagctgagagagctatgcccccctgtcccaaggtctgatatatattgaaatcttaatgtcttctaatttctccatgatcccatttttaattctgtgcacagctggctccttagtcctgctcaggtctcagctccactaccttctcctccgagaggctttctccagatgtcctccagaaggctccaactcccaacttctatcacatcaacctgttttatcttattaataccatttatcactctgatatttcttattttattttattattaaactaactgcctctactagaagacaaacaccttgagaacaggaaggagcttgcctgatcaaccactgcatccccagcatcgagcctggcctgacatgactgacaactcaaaatgtttgctgaataaataatgttgaactaaaaatcaaccagaattgactatagtatagaggattaaatgaaagatatacctctaatactctaaaaactttcatgttaaaatgaagggataaagtactttacaataatgtctcattttagccagcagtatagggaaaccatacaaaattcaatttgataagctaggtcagtggtttataaacatttttttccctctgcacagagtgatataaactttttctttttttttatttttatttttttgagacggagtctcactctgtagcccaggctggagtgcagtggcatgatctctgctcactgcaaaccccacctcccaggtcctggttcaagtgattctcctgcctcagcctcccaagtagctgggattacaggaatgtgccaccatgcctagctaatttttgtattttcagtagagatggggtttcaccatgttggccaggctggtcttgaactcctgacctagtgatctgcctgcctcagcctcccaaagtgctaggattacgggcgtgagccaccgcccaacctttcccttcctttctttccttttttaaaataaataatatttttttcctcctccaaaacagataaaaatattccaagagtccggattcctcaggcagtttatcgctctgtattcagctaatgtattttcttctaaaactttaatagtgatagagtttggaaggattgatagcatatatacttaggataaggaactgataggacttggtgagtacctggacatgagagtgacgataactctcatgattctggtttaggtgacttgaggaaaaggagatggttacccaagattaaaaatacaggcgatgagaacagatgggatggagacaatgttaccattagaatgcccatgggacattcaagtggagaagttcaggaggcaactcaaagcatgtctggagttcacaagagatgctggggctgtaattatagatttaacagccttcagcatacaggcagtaatgaatgaaattgcctgggaagaatgagtaaaataaaacagaaggctaggtagcaaatcctaatgattaatatttaagaggaaagcaaaaaggaaataatgaatcataccaaaagtaaaaactatagtgaccagataaaaatcctcaccttgaaactacaaatctagaaaagatgatgataaaacgagtaattctctgtactgtccattcaattgacatgacatgtgacatgctatttcacagtgggtccttcctggcacccaactccattttgtctgtgactaggctatgatacaacaaacaaattcaatgaataattgaatgtgttaccagaaaaattccctagtcctcccaaatcatcttgacttactcatggaacttaaataacccatcagctgttttgttactaagcaaggaagaagctttatcttccacctgtctcctaaacctgtttctgctccacaacacagtttaatttctattcctcacctctgctctcatacacctactttttattctgatgtaaggcaattatgaagccaggtatctcttaagatccaaaacaacttgtttatggcaattcccttactaagatcataaaaaccaaaataaaagttgggaaaaaatagcatgatacaggttggaaaaatgagatatcatatctatctctcccataacataagcaagctgtctgtaactcctttcacgcatcaactcttttccataaagcttctaatttctcatccaaacaacagagtagcttaaatatatacagtacttctgtgcctataaacattaacaacttcttgtggattggagaaatgactatatataaagaatttcaaccttcacaaaaaataaggatataggctgggcacggtggctcacacctgtaatcccagcactttgggaggccgaggtgggtggatcacctgaggtcaggagttcaaaaccagcctggccaacatggtgaaaccctgtctctattaaaaataaaaaaaattagccaggtgtggtggcaggcactcgtaatcccagctattcaggaggctgaggcaggagaatcatttgaacctgggaggtggaggttgcagtgagccaagattgagccattgcactccagcctgggcaacaggagtgaaattctgtctaaggatgtaagcgtccataatgctaacaataacgtcgctagtgacttaggtgaacaaaaatagtctgctttttactgaaattagttacaggttccaactgtaccattaaggacaacataaaattagagacatatatatatatatatatatatatatatatatatatatatatttttttttttttttttttttgagacggagtctcgctctgtctctgtcactcaggctggagtgcagtggtatgatcttggctcactacaacctctgcctcccaggttcaagtgattctcctgcctcagccttctggtagctgggactacaggcatgcgccaccacacctggctaattttttgtatttttagtagagatggggtttcaccatgttagccaggatggtctggatttcctgacctcatgatccacccgcctcggcctcccaaagtgctgggattacagatgtgagccaccacgcccagccaaaacataaatattttaagagaaacacacagtagtcttcacttgtgaagaatcacttgtgatgcccactgagatttatgcttcagtgagctacacaatgaaaaccttacaggcgacctgcttactggacaagctatactgccgacgtgtgactccaggcaatcaccaagtgtggagggaatacgatgatgaacttcctctcgcaaatggaatacactacctacttctcttctgttactctttgctgatgatatgccagcaaacaatcactatcattcttccgagcaaacaaacccaatcagccttgatgcagtaaaaaaaaggatttaaaattaaacatattttcaacacaaatagaattttgtacaacaggagagaatttttttaattgctaaaagtttattttttctttctattatataaagctaatatatgtttattatggaacatttagaagatagatatacaaaaagaagaaaattaaaatcatccataatcttagctccccaccaggtatagccactattaaataattgcttgctttttgtgtgtgtggttatttttgttgtttgaatagggactgggtttcatcaagttgcccaggctggtcgtctcaaactcatgggctcaatgatctgcccgcctcggcctcccaaagtgctgggaggataagcctgagacaccacacgtggcctgcttgttttttaaaagaaaaaatattatacaaaattaataaaggtaataaaatcaagtctatttagcctaaagcctgaagggagataaaaagcacaaggctatagtcattaaaactcttaataactagacctggtggccaggcgcagtggctcatgcctgtaatcccagcactttgggaggccaaggcaggcgggcggatcatgagatcaggagatcaagaccatcctggctaacacggtgaaaccccgtctgtactaaaaatacaaaaaattagccaggcgtgatggcacacgcctatagtaccagctactcaggaggctgaggcaggagaattgcttgaacccaagaggcagaggttgcagtgagcggagatcatgccactgcactcccgcctgggtgacagagcgagactccgtttctaaacaaacaaacaaacaaacaaactagacctggtgtggtggctcaagcctgtaatcctagacctttgggaggtgagaggattgcttgaggccagaagttcaagaccagcctgccaacatagcgacacacccatctgtacaagaaataaaaaatttaggccaggcgtggtggctcatgtctgtaatctcagcactttgggaggccaaggtaggtggatcacctggggtcaggagttcgagaccagcctggccaacatggtaaaatcttgtctctactaaaaaatacaaaaattagccggtgtggtggcatgtgcctgtaatcccagctacttgagaggctggggcaggagaatcacttgaacgtgggaggcagaggttgcagtgagccagaatcatgccagtgcactccagcctgggtgacagagcaaaatgctgtctcaaaaaaaaaaaaaagatataaaaaatttagttgggtctggtggcaggtgcctgtagtcccagctactcatgaggttgaggtaggagaatcatttgagcccatatggttgaggctgcgatgagctatgatcatgccactggactcctgcctgggcagcagagccagagcctgtctcaaaaaaaaaaaaaataagtaaataaaaattaggggaaaaaaaagtcttaataactacaaaggtaactcactattttggctgagtacttcccatcattagtacccactgccagatataccatcctgaacacaagcaaggaaggttaacccctctcccccaacccaatttttattttgaaaagcttcaaacctatagaaaagttcaaatcaccattcaaatcacctagactcaccaactgttcacattttgccacatttgcctttttgctctctctccacacacacttttctgttgttggatcacttaaaaatacagatatcatgaatttttaactttaagtatttcagcatgtatttcctaagaacaaggacattctaagcgaaaataatattttttatgaactaatcaaaatttgcaattctttctataaggctgaccaagataatggaacagactccataaaactgcgattagcttgaagcattaaagttcattttcttcctctttgctgcaccccatgtgactttcttttggaatacagtttctcaacctcagcaccaatgacattttgggccagataattatttgctggggcgggggtggggtggtgtcctgtggctgcaggatgtttagcagaatccctgtccctttacccactagatgccagtatcaccctacatccagttttaacaactgaaagtgtctctatacactgctctgtgcgcggagggcaaattgcccctggtgaagaaacactgctcttaaagaataggaccccctcaatccagatgaggagtataatgataatgacaacatctattgatctactgaatgcgtggcatatggcagcatgttctaagcagtctacgtgtgttaaatcatttagcccccagaataaccatctgaaatgggtggtgtagcaccttcatcttagaggaggaaatagacacagtgagattaagcacctcatgtgaatgaacaaaccaaagaatggcttcctgcaaaaactgagatccaacactatgtatctgaaccactattcttttttttgagatggcgtctctctgtggcccaggctggagtgcagtgttgcaatcttggctcactgcaacctgtcccccgggttcaagcgatactcctgcctcagcctcccgagtaactgggattacaggagcctaccaccgcacccagctaatttttgtatttttagtagagacggggttttgccatcttggccaggctggtcttgaactcctcaccttgtgatccacccgccttggcctcccaaagtgctgagattacaggtgtgagccactgagcccgacctgaaccaccattcctgaagtaaaaggtaactttgatggtacatactgcacttaaaaaggaaaaaagttcatatgtgaagttaataaaaggatgtaggaaaacaggcactctcatatattgctaatgattgttcacactgatacaaattgctaaactcccctccaggaaggaatcatctgacttaaaaatgtgtatacccttcgacccaacaattcatcctaagaaaataaccagttatacacataaaacagaggtgcagtgatatttactacagtcttttccataacaccgaaaaattgaaactctatcaacacccaaatacagagttaaatgacaatactttcatacaatgtaattctatatagccattacaaataatagagcacatcaaaagatgttcgtgatatgttaaagtaagtaaattataaagtagaatgaacggcataatcctagcaactataacacatagaagcaaaaatgttaaatgtgattatctccaaatatgagattctagtagtgttgttttcctttagcatatctgcattttcctttttttccacccctgttttagtttggcttttatttaaaagtcgttttgttttttttaatttattttttgactgcttttgcggagcaggctatcctataagcagtatgctgagagtagcgtattcagaagtttttaaaatggaagttcagatacaaatgaaaaggagatccctttgacactgacagaattaacatatagtttcaactacttgtactcaattccaaagacccatagtatgttacaaaaatgtgtggttcctattgctgaacacattgtgaatggcacaccacagaatgggtaggaaaaagtttcttggttagtcaccagggccggtcagttgtctagcctccacaccttaacccagctgagatgctgcgggatgaactctacaggtgatctaaagtgaatcccagagatgtctaggaaactgaccccgattgtggttccagagcactgagttcaggaatgtactcggcctagactaaaacagcctagaaaggctgaagctgatgaatgaataatttgttatgtctgatcctgattctgtcacactctgcgaccatactgtgtggcttaactccaggactaatgagggcacctggcaggcgaggcattctttagtgcatatctagttatgactggacctagagggacccagaaggtgacaggtacattttcaggctatcatccacaactgttcaccctttggagaaattttatttaacttggaaacatggcccatctctatcattaacctgtctgcactgacttttttttcttttcattctttagataagcaaattatttaatttttacccaaatggtatctctgtctggtctttccatcaatccacacccaacatcatcctttgtcattaaaacagttgtgtagttctctactccactaaataaactacggaaacatgcaatgtttttcaaaaagtggttttggaacctctgaggcctcatgaagtcctcaggaggtttgaatacagagtgctatgttttagcccatccacagttggtaccttcatctatcactctggagtgctgccctggtacaagaaaatatcaagtgcctgcccctgaaagcacacgcccactcctatgaaggactgcattggtactacagtcttttcctgccatcctgtacctctggtaagatgaattgttccacgggcttgtaccacagcttgttcacctgcacaccacagcttggaggactgaagcgagcaatgaagagggcctcctacaaattgggagaaaaagacaagaaaaaatacttcatgttatacattgcatatgcaaaaagttttcaaacaccttacttcttggtcagctaaatccacaatggccctaaccacggtcactaacatggttctactgtggttttggcatcactgggttttctagtgcagtcatggttattaaataacgatatttaaggtaatcaaagttgtcacgaaattctcaaatgctaaacataatccacataaccttaaaaaaaaaacccaccttgaaagaaaaaatattcagggaagtgagcagtgttgttaaattaagccaacacattatagtgtcaacactcccccaaagggttaaaactaaactgaaagacacagatttttactgggaacaaaagcactcaggaaactccgttcaaaaagaatcttcagaagaaaatataaacaaaacaaaaaagggaatataaaagaggactggagccaggtgcagtggctcacgcttgtaatcccaccactttgggaggctgaggcaggcagatcacttgaggtcaggagttccagaccagcctggccaacatgtgaaactccaaatttctactaaaaatacaaaaattagctgggtgtggtggcaggcacctgtagtcccagctacttaggaggctgaagcaggagaatcgcttgaacccaggaggtggaggctgcagtgagccaagactgcaccactgcactcccgcctggaccgcagagccagactctgtctcaaaaaaaaaaaaaaaaaaaaaaaaaaaaaaaaaaaaaaaaccggactgattttcactatgtctatcgttttcttgggtcctcccatttcttccaggcaacatttcctcattctcatgcctattcttatataccaacttaaccataggggaaacttctgttaagctcttaaaaccatgcaggggttcaaaattaagcacatttcaatggattatgtctatttctttcatgaacaccagttcttagcaatgcagtataagaatagtttttgcatcgtgactacccatgaacccattagcatccatcttagactagtccttccttgaggacaaagattaactcctccctggttaaaaatatggcaactagaagttatatcgacatgatcaaaatattgtatgtctgaaccaaactacttgattgataactcgcacactataaatagttttgttttttgagacagtctcactctgtcacctaggctggagtgagtggtgcaatcacggctcactgtaatgcagcctcgacctcctgggctcaagtgatcctcccacctcaacctaccaagtagctgggactgtaagcaaatgctaccatgcctgcctattttcttaattttttgtagagatggggtctcactgtattgcctaggctggtctctaactcctgggctgaagcaatccatctgccttgccctcccaaaatgctgggattacaggcgtgagccattgcgcctggctgatagttttttttttaaactatatatactaagataaacaagtgtatcaaaaaaattcaagattaattctaatttctagataacagtgatactcagagtactgctatttcaattacctatttgatcttcagtatcaatgaaactgttaactacaatcatatatggactcctatagttgagtatacaaagctcttctcactaatcattatagctggcatcatcagtagaaatcctactcttccctctgtcttatatttatgtctataaacacatcaacaaacgagacagattatttagaggaagaacagggcaaattccaaaaaagaaatttaatctcaaatttatttgtgtatttattgatgagtctctaacattatattcattgctaataatcaacattaataatacaaacacattttaaaaaactgaacagagttctgctgccagtaatatcagaccaattctcctatagatagtaactatgaactctggatgaaacataaaaaacaatgatttgaaggcactggaattcaaacaaacaggcagaaactagagaagaatcagtacttggaagaaggaaaaggctccaaatatgcatctcctccctaccccacttcttgactctttgtctgaggatacaactctagggtaactagaaatttgaatgaaaatctgtagtctttctgcttgaaaattaagaggacagagttggggcaaacacatcaattaataaaaggcattagggggaacctcccagaaaggaaaggatcacagagagagagaaccacaaattcttcatataaactctacccaaatctgtggctgactcatgaaatacacatacaaggcagaacccaagtagcccatccaaggccagagaaactgaatagagattttagctgtttctcactgcaagtgagacaatgtttagtctgtgtccagccaatttagctgcctgctaaaacaaaaaaaaaaaatcaatactctgaggaatataataggatccagagttcctacaatgaattatttacaatatctaggatacaatgcatgagtagcatgtagtcccagctactcaagaggctgagatgggcggatagcttgagcccaggagtttaaggctgcagtgaaccacgactgtgccactgcactccagctcaggtaaaagagcgagaccctgtcaaacaacaacaaaaaaaccaaaacccaaaccaaaaaaccccccaaaatactagacataaaacagaaaaatgttacccatattttagaggaaagataataatcaataaagacagacgctgagatgactcagaataagcgtacacagattttaaagctgctgttataactatggtcaaagctgtagagaaaaatattctcaaacaatgaacacataggaaattttagagaaatagaaacagtaaaaaagaactaaatggaaactgaagcactaaaaagtataatatttaaaataaatctaaaataaaaaattcattggataggcttaacttcagatttgagatgacagaagagtcactaaacttgaatacagatgaacagaagttatctacattagaaaagagaaaaaacactgaaaaaaatgaacagtcttgtgatctgcaggacaataccaaaagatctaacatacatgtaattggaatcccaggaggaatagagagagcgagcgaagtcagaaaaggttctgaagacattaatagttgaaaatcccccaaatttggtaaaatacatacatttacagattgaagaaacatgtagcacgccctgaataaaacagacaaagaaaaagcacaccaggcctggtgcggtgcctcacgcctgtaatcccagcactttgggaggctacttgggaggctgaggcagcactctgggaggccgagaagggcagatcacttgaggtcaggagtttgacaccagcctagcccacatggcaaaatcccatctttactaaaaatacaaaaattagccaggtgtggtggcatgcacctagaatcccagctacttaggagtaataaaccaaatacaggaaaacgttaattgttgtagaatgtagttagtggctatagggtttaccgaataattccttcaagttttcttcatgtttaaaactaaaaaacagatccttcaaatacatttccatgctgctacttcacatgcactctgtgaacaaatcagatttccctacatatcgggaatagagaaacctcactggttttctgttttctgtaaaagaataacttttattccctctatatccttattacaaaaaagatttgaagcagttattagccttgtattacagacttctacagttggaagtaagaggcaataatactcacttatcctaagaatcctaaactttttttatatccattaccaacttttgaaattccctaggttttagggaattttaggttggagatttctaatctagtcaactccttctcttctagatatagcacatttattcacagataatctatccccaaaccagtcttatatcacactacagtgtatttagtcaataggggaagaaaggtgaaagtctctcaaccagagagaattatatagtcttccaatctacttactgtatgtcacaaggaaaagttgatgtttttgaaaaagaaaaaagagaaaaaacctgtacagagcagggcatacctcttgttctgcctgataaagtttgacagtgatgttcctctggaaacccacatcattggcatcgtagaacactccaagactggtaataacgatggggtagagaactcggaaactcacgctgacaactcgatcctcaggcagccccgatgaagtgtcttcggacagactgaacgcttcaatttcctgattcaaaactaagtaatgagaacaggtttatataactgaacaaatgtaatcctttgttttactagtaagaagtagtgaagtgggcttaatgccaaaacctaggtaatcatttgctatataattcacaaatggcaggaatttttaaaaaatgcttgagaaaaatggctgcttctatataaacatttttgaaatttaagaatacagttttcagccacatctaagtaagttaattatcagaactgctttaatagctttttgcataaatgtgtgcatatatatgtataaacgccacaggagatattaaatttaagtcaactggaaggcatctatttggaagggttggataaatagaaataagaaaaacagtactgactgtagtcataaataatcagtaaatttggtcttactgtgcaaattccaaaaatcctacttcttgttaggcaatttaaaatacttgtgatacatcaggcaattattacggtataaataagcaactgaagtcacttcaaataacactgaaaaactcttgctgtacagcactgataaaagataagcatatcaaacacagttttgaaccatcttctatgtaccatttcccatcacatttatatcttcactactacccttgtggttgtggcattatctccagtttacatattaagaaactgaggcccaaaattaagcaattcacctaaggtcatagaaagtggcagatccaggaatcaagtcccatttagtgattccaaagtcagtcccctttccactccctcacagctgtctaatcagtgccaaaacagttcaaataatttttcttttatttcttcttttgagacagtcacccagtcacccaggctgcagtgcagtggcatgaacatggcttattgcagtctcaacctcctttgctcaagggatcctcctgcctcagcctcctgagtagctgggaccgcaggcacacaccaccaggccttgctaattttttgtagagatgggggtctcatcatgttacccaggctggtcttgaactgcaatcctcccgcctcagcctcccaaagtgctgggattacaggcatgagccactgtgcccagccttcaaataaattttctaattaccataaatgaatcagaatacattaaataaagcagttcataggcagggaatatcagtgctactttaataatataaaaccctattttaaaagattatatcaaagttctttgtatcttttagagctgtggttttcaaattttgctgactacacaacaccatcagttaaaaatatttgtacacacacctatttacttacaaaatatatgcatatattgtggtgagtctatatattcagtattaataaagattgtattttcttattttcagataaatagaaattctaagcctgggcaacatggtgaaactctgtctctacgatacaaaaattagctgggcgtggtggcacacacctgtaatcccacctacttgggaggctgaggcacgagaattgcttgagcctgggaggaagaggctgcagtgacctgagattgtgccactgcagtgcagcctgggcaacagagcaagaccctgtctcaaaaaaaagaaattacattttcttcctatactctaggtcatttggttgcccacgtcagacttcctagaagctctttacactcagtagatattcaataaaatgggattaaagggaagtgatgactcctacctaattatagacatgaacaggagggaaaaaagggagaatacagttttttgtcatgggctgggcaagcactaactggagagtctagactacaacataatggacaacaatacaattttttctctttaagatattcagtaaataatagatatccatagtagaaacctctttattaaaagcaataagtcaattataatatagcatttttagatattttcttatctaaaagaattgtgccttgagcttcaagttacgtggacacaggaaatcccgttgcattacagtgctattaaaccttctaccacagccacagtatcacgatgattaatgcttaccatgaccttcaggtactgaaataaccataactgcctttggatcatcgaaaagataagattaggttcaatattaacttagttatatacacatttaaaaattcataacctaggtattacatatatgaaaatgttcttttaacataaagttctacttctttacttttaataaataacagcacttaagataataaaaatatggttaatttaaaagtgaagggcttctttttgttttggtttggttttcaattgtaatttgttggaggatacatcagtggataccacatcagtgacataacattctatggggtttatgatccctttaagactccagtgaggccaggcgtggtggctcacgcctataatcccagcactttgggaggctgaggggggtggatcacgtgaggtcaggagtttgagactagcctggccaatgtggtgaaaccccatctctactaaaaataagtcaggcgtggtggcgggcacctgtaattctagctactcgggagactaaggcaggagaatcgcttgaacctgggaggtggaggttacagtgagccgagatcgcgccattgcactccagtctgggtgacaagagcgaaactctgtctccaaaaaaaaaaaaaagacaagactccagtgaaagccaaaggactttctccccagcacacaattcatacataaaatttgcttacaatgttaactgaattcacagacatcctaagtaagaaacctctattttgtaatacagacctgaatatattgtccaatttatttaaaaagctgtttgaaacccagctttataaaatagcaggctctttaaaataatgttcagtaccttccaccttctaggaactattattctaaatacatcatatgtatcaacttatttcatccttatgtcaatccccatgagggagattcttttatcccaagtttacagatgataaaactgaggcagaggaggtcacacagctagaaaatggcaaagcttggattgagagccatggagactgcttataaaagtgaggtgttacttaattatacagttttaacaaaccttaaaataccagaagtcctaatcagcatatttaagacttggaagtataacctcccttagaaacacagctgaacataatgggaattgctaataaacacagacagttaaaaacttatcaacttcctaaaattggttccctggtgacacagagaacctagttaggatcagctttctttcgttgtctttgtttttgagacagggtctcgctctgtcacccaggctggagtgcagtagcggaagcagatcatagcttactgcagcctcgaactgctggacccaagcagtcctcctacctcagcctcccaagcagctggaactacaggcatgagccacaatacttggctaatgttttttttttcagacatgggagctcactatgttgcccaggctggttttgtgctcctcctcccaccgtggtgtcccaaagtgctggagcagctttctttatcctcaccagaatttttacaaacttttaattttaaggcataaataatgttacttgtgtcttacattttttactattttttcttttacagaaataaattagacaataattctaagagaaagttgattcataatatttgtttcttcaagattattataaattaactggtaaaatcagcagttttccaaaacttcaaaatttggtaattcaggatttatctaagcataaggaacttccaaacgcgtatgaatcacactgaaaaataaagtctcctggatcctaaagttccaattctgtaaagaatctctacagataccccaaggcaatctgtcaaaaatgatgaaataggctgggtatggtggctcatgcctgtaatctcagcactttgggaggctgaggcaggtggatcacaaggtcaggagttcgaggccagcctgaccaacacagtgaaaccccatctctactaaaaatacacaaattagccaggcgcagtggtggtagcctgtaatcccatctacttaagagaggctgaggcaggagaatttcttgaacctaggaggcggaggttgcagtgagctgagatagcaccactgcactccagcctggacaacagagcaagactccatctccaaaaaaaaaaaaaaaaaaaaaaaaaaagatgagacataaatttggatgacagacattttagtctattaaaaacagactccagggcatggtggctcatgcctgcaatcccagtgctttgggatgctgaggctggtggatcccttgagggtaagaattcaagatcagcccagacaagacagcgagacctcaactctacaaaaaatttaaaaaattagccagttttcgtggcatgtgcctgtagtcctagcagggtggtgaggtaggaggatcgcttgagccccggagtttgaggttatagtgagccatgactatgccactgcacgccagcctaggcgacagagcaagaccctgtctctaaaacacataataaaataaaataataaaaaataaaaacagactccatactattaagcttagcaacttttactcaacatcaagcttgtgtatggcagtcaagggaaaagatgacttacctggatttgtgatgttgagtagtttacaggaataaggatcttccctgtcttccacaggcacttcacagccatgagcacctattatgaacttcacaagcacactgagagatgtgttggcattaacatcagttactgatcttcacctcgcacatgcacgtttcctcatgcccatttcagagcttttactttgagacacaagtgtttatgaggattaattctctacctttattcttctagtcagacaaaatgggggaacaagtaaactgaaagttgctaactaccaagttacttatgcatgagtcctttattgcaatgctatattaaagcaagtatgaatatgtctggcctcgctacaagcaaatgttcatatcatttaaaagcaaactatagtaaagtcagttctcatgcccatacctaaaaacatatctatatctaaaattttcctttgctgccttcttctatttcagaaagtgttccttttgctcaagattaggtctttccatccaagaggaaatccccttctctcctagaccttgcttcactggttacccccgtaactagtgactccttccctccacattacaaacatgataaagtcctgactctaattattctcttcaccttccatccttccttgccaccacactttacactgaggtcctacaaagaaattaaaactgcagcctgtttcttacttcccactcattttataaaacaagagttttagctttaatatcaccacctccactgagattccactaatgtaaccaatgagctgctgctaaatcaatagacactcttgaactcttaccttcctggtttctctacggcttaatactgcccagctccctaaaatgctctcttcccttccttctgtggcctgctcagtcatcttcactgcctcttgttccccagcttgtccactgagagtggtattagtctagggctctgcctttgggtcttttctcaatctactcattttttttacttcctctccctaaacaatattatttattctcatggcttcaaatagcatgggaatgattcctgaattagtaactccagttgttttctttttttttgagacagagtctcgctctgtcacccaggctggaatgcaacagtgtaatcttggctctttgcagtctccacctttcaggttcaagtgattctcctgcctcagcctcctaagtggctgggattacaggcgtgtgccaccacgcctggctaatttttgtatttttagtagagacgggatttcaccatgttggccaggctggtctcgaactcttggcgtcaagtgatctgcctgccttggcctcccaaagtgctgggattacaggtgtgagccactgtgtccggacctgaattagtaactctagtttagacccatgtaaaggacctgtaaattcactggacatcttcacccagataacccacagacagctgtgtgctaaagcctgctactactggcttctgggagccaactgtcaacttttcagaaattttgtgagacggttattaaacatagcctttatttaaaattaaattatataatcttataatatatattaaaatcaaaggaaatactcaaattaatcacttaatgttttactacattttactattatgttcttgagatcatttatatttattacatctacatggtggaaatagtatatatggcatgctactgcttatctttcccccactctgtgttcagtgatgtcacattagtcacttgaattggccatagtggaaatattcacaccctagaaactggcaaataatacaaataagggtttggtttattgttttgttgactgtctagacttaagaaagtatagagaaaatgttgataatgcaaattaagcttaatgtgatgtgtctatctatagccactacagagtgaatagttaaaaaaaaaaaaaaaaagtcaaggaagatacgattccagtgttccaaaactattacctgatacagcatagaagtcactgactttattaagtgtaaagctgacatatcttagttgtcactttagtcctcacctcactgtttaacttaaaagaaagacttttgtcacaactacactcttttgttaactgcaaccataagttggtcatagataggagagtctgacaaacaacaaaagcgttctatgagaatcaactggtttcatggaatttacgataaacagtattgtataggttattatctgtcaattacaggctgtatatactttatgtcaataaaatttataataaacatgtatgtacatataagcatcatttttcccagagagccagttagtaaacctttatcagtacactactgcctgtaggaacctcaaggtcaacatatacacaactgagtttctttcccatgaaacctgctcttctcttttagtatttttgttttgattgatgattccactattctccaagtcagaacactagcaatcttcctagcctcctcctccattttctacattcaatgaccttattctctcacaaggtcacccctctgatctctgtagatcagcccctcagcagtccttgccacaacaggtctcgtccttccactcaaccctccacatgcctgttacatgtgatctgctcactgtctgcctctcacagtcatatgcttcccccctcttttctttatatacacctctctactctcctacctctcctggctgtttctctcacactgtgccacaacccttcccccaccaccacaagccctgtgctcaagttatatagaagtgttaggagtttctcaaacaccccgggctattttatatctatttatatcacagcacatacaacattttattatacgattacacctatttccttctactaaatgtcaagcccctcctaacactctatttatctctgtattctaccacacatactacattatttgcttacagaagtacttagtgttgagtttgggtcctttggtgaaatgcaagaatggaaaatatgccataaccacagaaatgcagtttctgttactaattaccaattaaggcagaatacctttcatagataactagcatttggaataaaagtataaacagaaatgaataaatgtgctaactaaattattgcaagtatgtaccaaatttggttttttagccatcttactaggtactcttactagatccacaaaattactgtgtcccaggaaggtgtttctgcctaatatctatttttatacagatagctgatcattctcataacacaaatcaagcacgctaaatttaaagcaagactgttatgatggcaaataaattagtggtgaaatgtctgaatataaactatattcattacatttggttctgagtcattcattcaatagttgttgagtgccttagtctgcaccaagctaggttttaggtattgggaatacaccagtgaaaaaacctgaagccccaatgctcatgaaacctacattcaagtggagaaagacaaacaattttacaactaaatacaatacagatgccagctggtgataagtgttaccaaaaaaaaattaaagccaactaagggaagacacaaacaagataggggtgggctgctatttactatggggctgtctgctagagtgacatctaatcagagacctgaaggaagtgagtcctgaggacattagtgagagaggacgtaggaaatgcaaaggccctgaggtaggggcacttttagtgtatgaaagtacagtaaggcagccagtgtaggggaagtagatgtagataaggtcaaataccacaacaaagacttggagtttcactctgagcaagaaaggaggtcaatggaggggtatgaatagagaattgacataatttgactaattttaaaaggatcactctggctgctgtatggaaaataaaatgtagggggtcaaaggtagaagcagtaagttcagagaaggggacttctgcaataatccaggtgagacataatggcagcctagatcagatggcagtggtaaaggtggtgagaagtcagattctgggtatggtctaagcagcatctggaaggtatgctgatggattggatgtggcaggtgaaaggaaaaatcagggtaacaccaagggttttggtctgagcaactggtggaggagtcattattttctaacagggaaatactacaggaagtacagcttttggaggtggttctaatagtagtgatgattctgaggtctttcatttgctgtgtaataggctctattatcattgcaaccatgaactaaagaaacctgtcttgaaaaggaatgaaagctactatgagtaagcactactagtgacaagaaaattcacaactaggccgggcttggtggctcacgcttgtaatcccagcactttgggaggccgaggcaagcagatcacctgaggtcaggagttcgagaccagcctggccaacatggtgaaaccctgtccttactaaaaatacaaaaattagccgggcatggtggcaagtgcctgtaatcccagctacttgggaggctgaggcaggagaatcgcttgaacccaggaattggaggttgcagtgagccaagatcgtgccactgcactttagcttgagcgacagcaaaactccatctcaaaaaaaaaaaaaattcacaactgcaatttgcttgtatagctactcagtcacaaatgtgccagtgcaattcaatcctgaaagggccttctctgcttatcacctgagtcttcacatacatagaagtcaacttctatgcgtttcttcccctagtccctcactacacaatcttcagaggttgatctcattgagaacagactaaggctttgggcccctaactaataactgagagctatctaatgtcagcatgaaatggattaccaaagctcagttccagaagggtagtcaggaaaaagagcatggcatattacacatactgcagattacacaactaaaaaatactacaaaactgaaaaaaattaaatttatctctgtgaagttagtgaaaagtatatttagacatgcacatgtgtctaaggagagaactgctctagaacagaaccttttaagaattgctattctaaatcaaagcaaaaaacaaacaaaccacactgggtatctaaatactacacatgttaaccagtgaatatactctcttccaattatcatttggcttaaaatgttggttaaatttactttttggcccaaactatatggaagaaaagcaaatgaaacagccatttctcccaggaagagcccacatatctgaatgaacatttctattcaaagtaaggtttttcagaacttttttttttttttaaattaggcagggactcattcccatcatgcaggctagaatgcagtggtgcaatcatggctcactgcagcctcaattttccaagctcaagcaatccttccacctcagcctccccggtagctgggacgacgggcacacaccaccacgcctggctaggtttttcagaactcttatttcaataaaccaggcaaggcaacaactcagaaaacctaccgttgacttaatgtgggatgctgtagcaaatgtctcatccaggtgcttcttatcacgtttcgaagttcatggttattgcgagctgacaacacgccaactaccacatcatagtgagtagatttccactgaggaaataaggccaactgatctagaaataagaacaatacatgagaaataagtcatgtatcaattactatgaagttcaatatgtatcataagtttattacaaaataagcttatgtttgtaggaaattcagataaacacaaagaaaagaatttttaaatcacatatgaacccactatccagagacaaccactaataacattttggtttagagtatttttgtctttcacgtatatatgtatgtattcatgctcacgtaagtatactaattcttcaaaacaaacaagatgtggtaagaatctgtttcaaaaggcaacgtagcataaaaaaatagtaggcattaagagtcaattaggccacagttagaatccaggctctatcatatattaactataagttatttagcttcttgagcctcagtttcctcaactacaaaatgggtataataatacttctcataaagctgttgtaaaaattaaatgagataacatgtataaagctcttggtttggtattaggcatatatgaggcattcaatggcaactaaaaaaaatgtgctttgaaaagtgaggtcctacattaatgttagttattaagtttggcggatgacgctgaaggacttccataccggaaagtaatgcaacccttatttatatcaatgaattctatagccagtaaacctttcactacctacaaaatattctgaagaatgacgggaaagcaacacttttagtaaaaaaaaaaaataataataataaagtaagtcattctgaacggctcattttttactgtcagaaggtctaatgggcagggttacatttccatgtaaaacttgtccttagaagacagaagagaaagatatactttgtccttgtttttcatcaccagttttaaggcttgagagctacaagcttatatatagctctgatgaggtatccatttcatctctttctccagtggtgggaactgatccaaaacgtttccaaaaataaattattgaagcccagactctttactatattaaatgcaatgtttttatataccatgggatctaggtattcagtctaaaagacaacaaaaccaggttgatattttcttcaaaggcccaattaaaataataaaaacagatctttctactaggatagttttaaggatataatacagaaatttttgtgtagataccttattttccacaatagatatatttcttaaaatgtttcattctgggccaggcacggtggctcatgcctgtaatcccagcactttggaaggccgaggtgggcggatcacctgaggtcgggagttcaagaccagcctgaccaacatggagaaaccctgtctctactaaaaatacaaaattagccgggtgtggtggtgcttgcctgttatcccagctacttgggaggctgaggcaggagaatctcttgaacccgggaggtggaggttggggtgagccgagaccgcgccattgcactccagcctgggcaacaagagtgagactccacctgaaaaaaaaaaaaaagttccattccaaatggaatagaggtatttattatttcactctacaatgagtcatgtactaaaacgaattcttttataaagacaatttatttttaaataaattcaaattttcatggattaagcttattaataggccatatttattgaacagttaatctgtgaaaagcactacatatagagtatcatttaatgttcacaaccctatgaggtaggtacttgtttctttttttttttttttttgacggagtcccactctgtggcccagtctggagtgcagtggcggcgctctcggctcactgcaacctctgccgcccgggttcaagtgattctcctgcctcagcctcctgagtagctgggattataggcgcctgtcactgtgcctggctaatttttgtagttttagtagagatggagtttcaccatcttggccaggctggtgttgaactcttgaccttgtgatccaccgcctcggcctcccaaagtgctgggattacaggcgtgatccaccgtgcctggcccagtacttgttgaacaaatgaaacacccaaagaattcagtaacttaagtcaaacagcttggaaatggctgggctaagatttaatcccaggcaatctaacaccattctttatcactgttctattctaaagctatacagcttaatatagcttatctgagtctaaattctgatcttttaatccacaataccagttcaactgaattagcaataagcggatcattgaatacgctgggtaacacatcaattttttttaactcatagctcagaacattttttctcagatacataactatatgatggaagttgtacctagtgctggaactcactctaaatgagtgtctgaattcagagactaatttaaatgactatgtaaaactgacaatatgcctccccacctttttcacagagaaatatgtacattctagtgtcaggaaggaggcaaaacaaaggtagtgaccagccagttctgacattgattccacagccaagattttgcattacgttagtaagaaattatttaaatccctgtgcttcaacttcttaattagagaaaactgatacaaaaaaaattttggatattctatttcatttgtttcaaagtctcatctcaaaagattaaaagctgtagggcaaaaatcacatttaatctaaatgcctcatttatctgacatcatcagaaaataaggatgctgcacaaaagcaaactttcaaaatatttgaaacatcacttttaattccaataatttactaccttatttttgatggctaatcaaagcaaatcttttagaaatagattacatagaacataatttaatcttttcttgatgtctcaaaatcttcatgaaaatttctcaaatctatccctttcttgtcattaattctagctgctgctcagttcggtctgttttttcacctggaccagtacgagggcatcctaactggtttttacctgacttctccatataattgtcaaacaagatttttctaaaaataataaagaaatacaaagataaccatgtgacatgtgaaaatcccatggattatggatggaaacctctttttgatcttattccacctctctgccactctcaatcccccctgcttctaatccatgtctaagctgcttctgttcaactgctttactttacatgcatttctctttttcttgcagagggaaagtaacacggcatatcgtggtcttttagagaactacttcaagatatattgaagtcaaatgtcagaaaaataggttttttaaccacataccattaatgtaaattagtccaatagactcctgagtactgtgttacacagtacaaaacccaaagcagatgcataataaaatacctatgtaagaatgttgctcaaatttctagctccctttaccaatctagctctaaactcttatcaccttttatgttacaagaacagggtacctagttgactccagtgtctagaaacagagggaaaaaaagaaagtggtaagaagtaaacatgatacagaaggacataaagataattcagaaaagaaaaaaggcaaatagcaagcctatgaaaacatgttcaacttcaataagaatcaagtttgaattagagcaatgagacaccagttttctcctacattcaaactgacaaatgtcttcttaaatgattgtaactaaatgatggtacttcaaggaaatgttgttagtgatttcaacaaagtggctactctccgccgggcacggtggctcatgcctataatcccagcttcaattttgggaggccgaggagggcagatcacaaggtcagaagttcgagaccagcctggccaatatggtgaaacctcatctctattaaaaatacaacaaaaattagctaggtgtggtggtgcatgcctgtaatcccagctactcgggaggctgagtcaggagacttgcttgaacctgggaggcagaggttgcagtcagccaagatcccgccactgctctccagtctgggtgacagagctagactccttctcaaaaaaaaaaaaaaaaaaaaaaggctactctttttcattgcgggaaggaatgtaatttggtacagtcttctgcagggcaatttggcaatgtgtcaaataatttagaatggtgtaactttgtccagcaattctaagaactcattctaaagaaataatcagtgatacactcagaagatctttattaatcatagtgtcacctattaatagcgaaaaactgcaagctacataaacacataaaggactcattaaataaattatggtgtagctatatgacagaatactatgcagccattaaaattacatgttaatcatatcattaaacattattctattaatacatcatattaagataaacaggcgataggaactatgtagatactagacggttctgtttatataaagtacaaaagtagccaaatttctgccactggttactatccctggtagtgacaaaacagagcatgaagggaacttctgaagcactgatagttttctttttttaaatctgggtggtgattagttgggtgtgttcaatttgtgaaaatacatcaaactgcgccagttttattctcttgatttattcactcaaatgacagagcatctcctatgctcattgttctagatggcacagatacagcagtaaacaaaatcttcataatgtcaggactaaatcacaatcccaagcaagctccctgagggcaacgtaagggccaagggaaagttttccctctgaaggttcggtgaaaatcactgacaagagatggacaggagaaaaggcatataaatttatttgatcagtaaagatacaggagaaagtgcccatttctgtgcttaggtttaacaaagtatagatagctatgtggaattaagattggacagaaagggtaggatctaatgttaacagatggagttggaaaacccagcaaggcctgtctagattcttcttgtcctctctgagtatacattctttcctactgggtatgggataggaccctctctggtatgaggttcttatgacctgtaataaaagaaggtaagttaggtaatttttatatagaaaggtggtggtgggggctagttagagtaatatgtttaggttttatggctggctttggggaagagggattttagtttctacagctagcctcaggtgagaatgcaaggccagagagaggacagcagcagcaggtcagagacagctgcttctgaggccttattttggggtattgttttcttctgagaccctacagtaagaactatttcttttcttaatatgtaatatatcctgagagtctggcaacctgctcaaccctgcactgtgagtggacatccaaaggtatattaaagtctaagggagggcctggcgcagtggctcatgcctgtaatcctagcactttgggaggccgaggtgaatgaatcgcttgaggtcaggagttcgagaccagcctggccaacatggcaaaacgcagtctctactaataatacaaaaattagctgggcgtggtggcacacacatgtaacagaggctgaggcaggagaatggcttcaacccggaggcagaggttgcagttagtcaagatggtgccactgcactccagcctgggcgacagagtgaaactgtgcctcaaaataataatcaaaaaagtctaaagaaggttgacatcaaaattgattgctcaaaataagcccaagagtcttaaaaatcagaccaaaattccactctgatatgcatgctcttggaagagtcacaaatagatacaaatcttgaaaatgaagaaaacatgtgagcctgtcacagatctaatgataaagacaatcatcatacacactaccaaagacacctcccaaaacaccacactagcacaggcatcagcggccaccagactaccactcctctctcaaactcatggagtgtttactatgaaacaggcactgttgcgggtgtttcattaattgaatcttcacaataagtctatgagatcatcatcttataaataaggaaactgaagcacagagacacaattagcatatagggataattttggaagaactcaccccaggcaaaattacaaagcaagctcaatttgttttctgaccttctacttgctctacatctgtttccattagatactgtgagcaccttgggagaagggactaggcatccagcacagaatctaacactcaagtacttgttgagtgaatatgctcctttgttttggtttctttctttccagataccctagaaagcgaagccttcttttgtcacatcatttttctaaattaaccgttaaataattcctacttaaggcattacccaaaacgagcattttgtaatcaagatatcctatgtttagattccttagtccgatggttatctccacctgcattttcctctgtcaccctcaggtgtactggatttcacttcctctttaccagttgctttccctgactggtttaagggaacctatcacattaaaaaagttgctgattctggtactaaggtgactcacttacttcattctggtccctgctcaactgttacctcttcagaatggaatggacttccctgacctatttaaaaccatctctttaatctcttaacactgctttatcttttttccctatacttatcactaccgctgtgatatttataattatttcctgatgctctgtcttcccttctaaattgtaaactacatgagggcaggaagtttagcttgattactgctgtaattccacacctacgataggagctggcacagagtaggctctcaaatatttgctgaatcaactgcgagccaaagaaccttttttaatattcagggaaggtaaatcgctctttcaaaaaaaacaaagaaactgccattacttaatgagactgaagacagacaaagcagcagaagaggaaaaaaaatacatttaaaaatgttaattcaagaaaagaatacttagcaaaatcttgggtttttttttctcctgttaggcttaaagtacaagggttaaaatgtaaaaacacccaactattttagtttcaacatggtgacagcacaatggtaaaggaattatgggaaattttagcatttaagatgcttccactgcttttagctttgaaagtaccaaaaggaaaaaaggaaaggtaggagtcagtcttgtttaattaattaattaattattttgagatggactttcgctcttgtcacccaggctggagtgcagtggcgcaatctcgtctcactgcaacctccgcctccgaggttcaagtgattctcctgcctcagcctccttagtagctgggattacaggcatgcaccactatgcccggctaatttttgtatttttagtagagacggggtttcgccatgttggccaggctggtcttgaactcctgacctcaggtgatccacccaccacggcctcccaaagtgttgggattacaggcgtgaggcaccgcgccgggccagtcatgtttaacttagattattaaaatatcgatggttgacagctgcagcaaaccaccatggcacacgtttacctatgtaacaaacttgcacgtcctgcacacgtatcccggaacttaaaaaaaaatcccatttattatctgaccagatatacagtactcattcaaagccaaagttaattaacataactagtattgatcttcttacctacgttattaccctgttcctttctatggtctacttcttcatttccttaatctagcctggtctaactactggatggcagataaaggcatcatccttcaagtgcagtaagggagtaggaaaaacttgtctcaaactagaaaactgcctagcaagtctactaagatttcagtttgaagtctactaacatttcagtttttgtttgttttactgaaccctaaacaaccattaaggccataaacagacttaatgacgctctacaaggagattccagcagggctcactcataacaaaagagagaaacctgtaacacacaagcagctgttacaaagcattttttataaatggcgttctcttcttagttcacttcacaaaaacctaaaaaacactgagcaaaaccctgaccccatcaactggttaagtgcatagcaacactgtactttcattaaatcacttaaatagtgtttaattctattcaggtcacacaaatccttttcaaagagctagtgatctaataggaaaagagattgttaccaaaataacctcaacataatttcatataactgagactgttttgaggattgccgaatactttctacttataaggcatagagtgctgaactgcaaacactcaattctaattttaagaacttttggattagaaaacagctgttttggggagagatggtaagggaaaaaagtgccagtatagttacaaaattaagtattacataatatttaaaagagctttctaggtttctttcatgttctagggcaagcccttaaagaagaagacaagagatacagggaaagctaaagtagtgttcagggtggtggaacccactaacaaaacaatccgctgggcaccgtaagtaaagcattctattaggctgtgacgcgaaacaagaacaaaggtttcattcctacgagagattaagttttagagcaaatggacacgatcgttaaagaatttgatatttccatgtaaactgcattagcaggttatgcgatccaaactcacaggaacaactccaactctcggccatgccctatttcatgtctagatttgtttaaccgacttacatcataatccaagaatacgaactacagtatattcttacagcaaagttattccttaaaagcaaaaccgagccacctttgaaaacacgcacacacattatccacggcactaaaaccccagtcttgaccgagaaagaccaacaacttgggggggaagaaaacaacttcagagccagagctcccaaagcagaaagcgctggcggctgaagggcacacgaggttccgctcccgggcgaacgggcggcgtcggacatcactaaccaggcctggggacgggcgaaggacttgcagctgcgggcgccggctctgcgggcgttaaggcaaacggggaagtgagaagcggcggggacacgaaaagagaaaagctccctcaagtttgcccgatgttaacgctccaaggatgaaaagagccgtttgtttcgtctggggaccgtcgcgtttggcccttcccccgcctccaacaattcccggcgaagccccgcggcaccaagccgggcctcccacccccccggcggccgccaacccgcccggccccaggacctcacctgcagggccggccccggaggcgcaggcgggcggcggggagcgcagccgcagccagaggtgcagcgcggccccgagcacacacgggcacagcagcaccagccagtttcgcattggccgcccccgccgcgagccgggctctcccgcgtcccggcggagagggaggggacctgcaagtgcggagactgaggggcggcggctgacgagcgaccactccgagcacgcccgccctcgcgctcggcgacgtctggagggctcctcgcagctcccggccccgctcctccggtccctcagaccgcgggtggccgcggcttagccggccgaagccccgccccctccgcct

SEQ ID NO: 889 - DNA, 81554 bp, Homo sapiens
cctacagcacttccggccagagcctcaagcttcgctgctgggcagttggctggaggggctgctgctgggaacacctggagtctccgcgggcaggtgagcttcagaggttcggggagctttcggaacgagcattcctggccggtgcgtcaccctgcagtgctcttggccttttcttcctttcctggaatcttcccagattgccagagccgggcgttgcctgctccgtgcgctgggaggcggtccagccggctgggttggggccaccctgcgcctcctggaaggccttatttaggagtagccgcacgtgatctctagcattttaagcttctctcagagaattggcatgtcactttggaagaggtgaaaatggtacaggcgaccaacgacttttacaaggtgtcaccttagaggaacagcctcgtccttccgaatcagttaacattggtgatgacagagaaataacgttaaataggtggagagcacttaaagtaactgtttgttcttttgagacagtcttgctctgtcgcccaggctggactgcagtggcgcggatctctgatctcggcttactgcaacctccgcctcctgggttcaagcgattctgctgcctcagcctcccgagtagctgggattacaggcgcgtgccaccacgctcggctaatttttgtatttttagtagagacagggtttctccatgttggccaggctgctctcgaactcctgatctcagatgatccacccgcctcggcctcccaaactgctgggattacaggcgtgagccaccgcgcccggcctaaagtaactatttttacttggtgtttactaccaaatggggactgttctaagttgtgggtggatccaaatgatggtgtgacagccttatcctcagagaagcagtcctggcaggaagacggggttaacaaattgccaaactgttagagaaagttagtggaggtagagatgaagagagaagacttttcttttctctggcattaatttagccacggccgctgtgttttgatacttgcttcaaacgtttttcatattcttaagttttaacttttctgtatgctcatattttatatactgttgtaaacagcatatctctgggttttttttttaatctaagtggacagcctgctttttttttttttttttttttttgatatggagtcttgctctgtcgcccaaggctggtgtgcagtggcccaatctcagctcactgcaaccacgcctcccaggttcaagcatatctcccacctcagcctcccgagtagttgggatgacaggtgtgtgccaccatgcccagctaatttttttttttttgtatttgtagtagagatggggtttcgccatgttggccagactggttttgaaggcctgacttcaggtgatccacctgcttcagcctcccaaagtgctggggctacaggtgtgagccaccgtgcccagcccagtctgccttttgactagcaggtttattggatttacattcattgtcactactgaaatatttgtctagatgaaaatctttggtatcatccctgattaatctcttccatatatatcagcaaatcctatggactctccacctttaaaatctgtccacactcccaggctcttgttatcaccttcacttgttcaagttacgttgtctcgtacttgaattactgcagtagtttctgctctttcctcttttagtctgtttgcatcacagtatctcggttgatcctttaaaaaaaaatcagatttatgtctttcctctcaaaaatcctccaaggactacacatttcacctggagtgaaagccaaagtcggccgggcgtggtggctcatgcctgtaatcccagcactttgggaggccgaggtgggtggatcacgaggtcaagaggtcgagaccatcctggccaacatggtgaaaccccgtctctactaaaaatacaaaaattagccgggcgtggtggtgcgtgcctgtaatctcagctactcaggaggctgaggcagaagaatcgcttgaacccgggagacagaggatgcagtgagccgagatcgtgccactgcactccagcctggcgatagagcaagactctgtctcaaaaaaaacaacaaaaacaaaaaaaacaaaaactggctgggcgcagtggctcaagcctgtaatcctggcactttgggaggccaagactggtggatcacctgaggtcaagtgttcaagaccagcctggccaaagtggcgaaaccccgtctctactaaaaaaaaacacaaaaaattacccaggtgtggtggtgtgtgtctgcaatcccagctattagggaggctgaggcaggagaattgcttgaacctgggggcaggcgcggaggttgcagtgagccgagattgtgccattgcactccagtctgggcaacaagggcaaaactctgtctcaaaaaaaaaaaaaaagccgaagtcttcagagtggattattcatcgaaggtcctatgtgacctagccctgcttcactgctgatctcatgtcgttctcatctcctgtttgctctactgtatggtctcctcaagcgcatcctagcctcaggatatttgcacttgctattcctttccctcatatgtccacatggctcagttctttacctctctcatattttggggacctttaccttctcagtaaggccttctctgacaagccactgccatctttaacatttccattgcactcgttatccttgtgcttatcatcatatgacatgccatgtgatagagtcatttatctggtttattatgttttctctcactggcatagaaggtttatgagggcaggtatttttctgttttgtttactgctgtattctttttttttttttttttctgagacggattcttgctctgttgcccaggctggagtgcagtggtacgttctcggctcactgcaacctctgcctcctgggttcaagcaattctctgcctcagcctcccaactagctgtgattacaggcgcatgccaccatgcctggctaatttttgtatttttagtagagatggggtttcaccatcttggccaggttggtcttgaactgctgaccttgtgattcacccgcctcagcctcccaaagtgctgggattacaggcgtgagccactgcacccggcattttttttttttttttgggaagatctcttattgtacttccctgtaaaatccattactgttttattccaattgcctaaaatagtatctggcttttagcagacactccataatataattgttgattgaatgaatttggggtttttgcaccatcttctacacttcatatttttatgcttttttcctccttgtcttttcttttttttttttttgagatggagtcttgctctgtcgctcaggctggagtgcaattgtgtgatgtcggctcactgcaacctccgcctcccgggttcaagcgattctcctgcctcagtctcctgagtagctgggattacaggcgcacgccaccacgcccagctcttttttgtatttttagtagaaatggggtttcaccatgttggtcaggttggtcttgaactcctgacctcatgatccgcccgcctcagcttcccaaagtgctgggattacaggtgtgagctatcacgcctggcttttttttttttttttttttttttttttttttttgagacagagtggttgctcttgctgcccaggctagagtgcaattgcatgatcttggctcaccgcaacctccgcctcctggcttcaagcaattctgccacctcagcctcctcagtagctgggattacaggcatgcgccaccatacctgactaattttgtatttttagtagagatggggtttctccatgttggtcaggctggtcttgaacttctgacctcaaatgatccacctgcctcagcctctcaaactgctgggattacaggcgtgagccaccgcccccggccactcttgtctttttttttttccctttttttttttttttgagacagggtctccctctgtcacccaggctgtagtgcactgacacgatcttggctcactgcaagctctacctcccgggttcaagtgattctcccacctcagcctctgagtagctgggattatacgcgtgtgccaccatagcctggctaatttttgtatttttattagagatggggtttcatcatattggttaggcttgtctcaaactcccaacctcagttgatccacccacctctgcctcccaaagtgttaggattacaggcgtgagctacagcacccggccccacctttttttctgagacagagttttgctcttgtcacccaggctggagtgcaatggcacgatctcggctcactacaacctccacttcccggattcaagtgattctcctgcctcagcctcccaagtagctgggattacagggacccgccagcatacccagctaatttttgtttttttagtagaggtgggggtttcaccatgttggccgggctggtctcgaactcctgacctcaggtgatctgcctgccttggcctcccgaagtgctgggattacaggcatgagccactgtgcctgccctttttttcattttttcatttttttgtacaatagggtctccctctgttgcccaggctggagtacagtggtgtgatcagggctcactgcagcctcgaactcctgggctcaggtcatcctccaacctaagcctcccaaatacattggcctataggcgtgcaccaccacacccagctgatttttatattttaatttttaattttgctgtgcatatttagctgggattacagacgcactccacctcgccaggctaatttttgtatttttagttgcaacgggatttcaccatagtggcaaggctgctctggaactcctgacttcagatgatcctcctgccttggcctcccaaagtgttgggattacaggcgtgagccaccgctcctggctggctttgtagaaccttaaacatatttatctatcttaagaatttttcccaaggaaatacttcataaggtaatattttaaaaatcaaagctgtttttagctgttttctttggagttgtaaataaacagcattagagaaatgattggctgggtgcagtggttcacacctataatcctagcactttggaaggctgagacgggagaatctcttgaggccagcagtttgagaccaacctgggcagcatagagagatcccttctctaccaatagaaaagagagagagagagaggctgggcacggtggctcacgtctgtaattccagcactttgggaggccgaggcgggcggatctcgaggtcaggagatcgagaccatcctggctaacatggtgaaaccacgtctctactaaaaatacaaaaaattagccgggcgtggtggtgggtgcctgtagtcccagctactggggaggctgaggcaggagaatggcgtgaacccgggaggcggagcttgcagtgagctgagattgcaccactgcactccagcctgggcgacagagtgagactccgtctaaaaaaaaaaaaaaaaaaaaaaagagagaaattattaagtaaattgtggtatcatacttggatattgagatgattaatgtgttgactctgtggctgtatagaaaaatgtttatggacaaatgttaatatggccagttgaggtagctcaaacctgtaatcccagcactttgggaatcctcaggaggattgcttgagcccaggagttaaagaccagcctggataacatagtgaggccctactttattttaaaggaagttaataaaagaagtagaacaaattatatgtctcagtggtagtaaaattctgcttacatgttaatgaaaattttgaaagggcacttaaaactagtaaaaaactcatttttagggtaatacaattgtagtaaaatttaaacatttaaattttatgatcggaagatggtagtaaatcagaaatggctttggaatttctttcattgcaaccttaatagtaagcaacagtctttcccatgaaagggacagaaaaaaaagaatgtaacgtctacatttttttttttctttgagacgcagtctcactctgtggcccagtctggagtgcaatggcacgatcttggctcactgcaacctccgcctccagggttcaagcaattcttgtgcctcagtctcccaagtaggtgggattacaggcactcaccaccatgcccggctaatttttgtatttttatttttatttatttttatttttattttattttattttatttttgagacggagtctcgctctgtcgcccaggctgaagtgcggtggcgcgatctcggctcactgcaagctccgcctcccgggttcacgccattctcctgcctcagcctcccgagtagctgggactacaagcgcccgccaccacgcctggctaatttttttgtatttttagtagagacggtgtttcaccgtgttagccaggatggtctcgatctcctgacctcgtgatcctcccgcctcggcctcccaaagtgctgggattacagacgtgagccaccgcacccagacttgtatttttattttttaaattttaaaattttatttatttttttgagactgagtctttctttgttgcccaggctggaatgcaatggcataccttggctgactgcagcctccgcctcttgggttcaagcctccagagtagctgggattacgggtgcttgccaccatgcctggctaatttttgtatttttagtagagacaggtttcaccatgttggccaggctggcctcgaactcctgacctcagataatccaccctcctcggcctcccaaagtactgggattacaggcgtgagccactttgcctagcctacactgttaaatgaatgcttttcagaccattgtaccccacgtgcaggtcaggccacatctggaatgtggcgttcagttctagatatcgcaatttaagcatggaatcagtaaatcagttacagaggaaaactggaatgctataaggagggtttaaggagctggaaatgtttaccctggtagagaggtttgggagatgaagacaggaagcagggaaagcagaaatggtaacaaatggccttccatatttatttatttattttttgagactgaatctccctctgtcgcccaggctgaagtgcagtggtgcaatctgggctcactgcaacctccgcctcctggattcaagtgattctcctgcctcagcctccctaggagctgggattacaggtatccgccaccacacctggctaatttttgtatttttagtagagacggggtttcaccatgttggccaggctggtctcgaactcctgacctcaggtgagtcacccaccttgtcctcccgaagtgctgggattacaggtgtgagctactgtgcccagctggccttccacatttaaatgttgtctgggaaagggaatatattgattctctgtagctacatagggcagtagtagaaaattactaggtgaaaatgatagagatgtagatttctttttttttcttttttttttttttttttgagatggagtctcactctgttgcccaggctggagtgcagtggtgcgatctcggctcactgcaagctccgcctcctgggttcacaccattctcctgcctcagcctcccgagtagctgggactacaggcgcccaccaccacgcccggctaattttttgtatttttagtagagatggggttttgctgtgttagccaggatggtctcaatctcctgacctcatgatccgcctgccttgtcctcccaaagtgctgggattacaggcatgagccactgtgcctggcctagagatgtagatttcatctttttaaagaagaataacaagagtcactccaacatttaagtgggctatcttcattagttagcaagtgtgtgtattttaaaaagtcattccatctgaaccaagccttagtcagcacccagatagacctaactaagagcaacatgccactcacattcaggtgattaggagagggcccagtgcaggccattacagagaacttaactaggcagcagctgactgcaggtcattttgactggatactaaaatggggctgggggtgggggagtgatcaaagtggttgtcctagcaacaggcaataagggtgcagagtgggccagtaacagcatcaagtaggtctaacatcaggaaacagggacccactggttactagctagaagaagagggtaaaggctttggaactaaggcataggtcaccaagacatggatccagtttctaggtcttcacggaagatcatggtatcaagaaagacattattagaaacgttcagagactagacaggatcatcaaaaatactgacttgaggctgggcgcagaggttcacacctgtaatcccagcactttgggaggccgagatgggtgaatcacctgaggtcaggagttcgagaccagcctgaccaataaggtgaaaccccatctctattgaaaaaaaaaatacaaaattagccgggcttggtggcacatgcctataatcccagctactctggaggctgaggcaggagaatcgcttgaacccgggcggtggaggttgcagagctgagatcacgccattgcactccaacctgggtaacagagcgagactcttctcaaaacaaacaaacaaaaacacctgacttgacacagagactgttaattactgaccttagaccttatacctaatgatctcattggtcatgtctgtgggcacagcatacaggtaggaatggaaaaaaaaaattgttactggagattaagtaggatcaagcatgtgaaggaattcatgagttacctacagatgttagattaataatgagaatggcttcctagtgtcttcaatcctcattcctgctattacactctctggttttacttcccattgatggctgcccccttcttctcaccaagccattctcactgttagcctgatctgcagggtgatgtagtagtacccttaagctgagccccagctggaaagagcctcagactgattatggggccttgtgagtttctggatttagataatccctatacagtctagttcatggagccaagatttggcctagtactttaatttcttgtaggagtggagttctgcagtcattttattcgtccctcttcttagggactagagctctgaatctgagcacaggtttttgggtagtgctgtgtctctggccagacctcttagcttactaaaacataaattccccatgcctggtctgacccgtatgttgatcctgccatcacatcatctaaactggccggcacagtggctcacacctgtaatcccagcacttggaggccgaggtgggaagatcacttgaggtcaggagtttgagaccagcctggcccacatggtgaaatcccgtctctactaaaaatacaaaaattagctgggcctggtggcggccgcctgtaatcccagttactcaggagggtgaggcggaagaatcgcttgaacccgggagatggaggttgcagtgagctgagattgcaccagcctgagcgacagagtgagactccgtctcaattaaaaaaaaaaaatcatctaaactgctttgacttttctcaccaactttgggctcggagattatttctcttttgcttttcaacactactgggcatgtttagatctggatcctggcccccttcccaatggccctgtcctcctttatttaaatagacaaaattcagctccattttgaaagtaggattcttttcacaacaattgggaaaaatgattttttttgttttgttttttgtgagatggaattttgctctgtcgccaggctggagtgcagtggcacgatcttggctcactgcaacctctgcctcccgcattcaagtgattctcctgcctcagatggccaagtagctgggactacaggcgcgcactacatgcccaactaatttttttgtatttttagtagagacagggttttaccctgttggctgggatggtatcgatctcttgaccttgtgatctgcctgccttggcctcccaaaatgctgggattgcaggcgtgagccaccgcgcccagcctaatgttattgtttttacaaaatatttgaggagctgattgagaggaccttatgcagaaacttaataaacttaaaatcatataatgtgagattgaaatgcttagattattctgtaatatggaaatagcaggtctaatgtaacagacaactccagtaacagaggaaatgtctacctattctttttttttttttgagatggggtcttgctctgtcacccaggcagaagtacaatggctcgatctcggctcattgcaacctctgcctcccgggttcaagcgattctcctgcctcagcctcctgagtagctgggattacaggcatcgcgccaccacgcctggctagtttttgtatttttagtagagacggggtttcaccatggtggtcaggctggtctcgaactcctgaccttgtgatccacccgcctcggcctctcaaagtgctgggattacagacatgagccaccactccccttccatctacctgttcttaaaataaaaaaaacccataaaggtggagaggtaataataacaaaggcctcagatatctatataccaatggagtttgtgggtagtcagtaatgtattctaaccccagatggcatgtaacagcatatgttttttcttttgttttgtacacatattatatatgataatattaaaatagaaaaatactttgttcaatagttatgtaacttgtcgtttaaaaatccttgtacttcaacactgttatcttttatttgtgtttttttgtttgtttgttttgagacaggctctagctctgttgcctaggctggagcagagtggcatgatcttggcttactgcagcctcagtcttctgggctcacatgatcctcccacttcagcttcccaagtagctgggactacaggcgtgtgccacaatgcctggctaatttttgtatttttttttggtagagataagtttcactatgttgcccaggctggtctcgaattcctggcctcaggtgatctgcctgccttggcctcccaaagcgctgagattacaggcatgagcaaccgtgcccagccaacactgctagctttttaaaacagaaagtgagttttatttaggccggccgcggtggctgatgcttgtaattccagcattttgggagactgaggtgagtggatcacttgaggtcaggagttcaagaccagcctggccaacatggtgaaacaccatctctactaaaaattcaaaaattagctgggtatggtggcgtgtgcgtggtggcgtgtgcctgtaatcccagttactagggaggctgtggcaggagaattgcttgaacccagcaggcagaggttgcagttagcagagatcgtgccactgcactccagcctgggcaacagagcgagactctgtctcaagaaaagaaaaaaagaaagtgagttttatttagacaaagatgaaggtttggaaattaaccatatttgtgcttgcaaaaggggcacggatttttaagccctagtctcacaggctctctctgcagcatctgatactgttgcttgattattcctgctttaaactctgtcccttggattccaaggcatcaggtagctgctcttcttttttcttttctgttttttctttctccgacttcttagggatttcttctttcttaactattatgtttttgcaggattctgtcattgatccccttttctttctagctgataccctttcattctcatctactttcatgctatcagttataagctctgtgctgacaacccctaaaaacatgtttctaggccgggcgcagtggctcatgcctgtaatcccagcactttgggaggcagaggagggtggatcacctgagatcagaagtttgagaccagtctggccaacatggtgaaaccccgtctatactaaaaatacaaaacaattaaacagcatggtggtgggtgctgtaatcccagctacttgggaggctgaggcaggggaattgcttgaaccagggaggtggaggttgcagtgagccgagatcgtgccacagcactccagcctgggcaacagagtgagacaccatcttaaaaaacaacaacaagaacaaaaaaaacacatttctagcgcaaatgtatcgtttgagctagagacccacatccgtcatcaccctctataggcactttaagtatactgacttctctcccaaacttgaaccttctcttataggccaggcgcggtggctcacacctgtaattttaccactttgggagactgaggttggtggattgctggagctcaggagttggagaccagcctgggcaatgtagcaaaaccccttctctactgaaaatacaaaaattggctgggtgtggtgaagcacatctgtggacccggttactctggtggctgaggcacaagaacccttgagcctggaaggtgggggttgcagtgagccgagattgcgccactgcactccagcctgggcgacagagcaagactgtgcctcaaaaaaaaaaaaaaaaattcctttaaaggaattgtattaagttcttatcagtgttgtatttttcttcctagatctcatattttggattctggatatattataatgagtgacactttgacagcggatgtcattggtcgaagagttgaagttaatggagaacatgcaacagtacgttttgctggtgttgtccctcccgtggcaggtaagcaattattgtgtgtgtgtgtgtgtgtgtgtgtgtgtgtgtgtgtgtgtgtgtgtgtgtgtattttgcagctgtttctgtgtaagcttctcagtagcactttataccacaaattttgacgaaattaacaactaatttataggtgcctcctgtatccagttttatctgagtgacagtatcctgtggtatctatgattttgtttaattatatgccatttaattatttagtgttgctatcttatataaaatcaaccttaaaatatcttctgaggaaactataaacagctaaaagtcttgaaacctcataaacctcaactcaagtaatttttttgaaatttcttttgtcattaatccacgtgtgtaggtatctaatatagtttaaactgatacacattacaatttttgttaccttttttttaaacttattttttggtataaatttacctatgtttctacagcattattttgcaatatttcttctttttttgattttgcgtatttcttaattattacatttagtataatatatagtttgtttaattgttccccatttttggatgttaatttctagtttttagagtaaataataatgtagtagacttactcataagtcttagtcaacaaaaatttgactgttttctgtgtattttgagacagagtttcgctcttgttattcaggctggagtgtagtggtgcgatgttggctcaccgcaacctctgcctcctgggttcaagcgattctcctgcctcagtctctcgagtagctgggatttcaggcatgtgccaccacacccgactaattttgaatttttaggggagacagggtttctccatgttggtcaggctggtctcgaactcctgaggtgttctgcctgcctcggcctcccaaagtgctgggattacaggtgtgagccaccgtgcctggccaataaggaggctttctatgaactgggcaactgctggaaccaagctgatatgggtttactagctgattgcaatgtgcccagaattagaatatttatccatatttttacattacccatccctcttgtttcttctgagctgcagccagagatcaccagttggttcacaggaataagcagggttagcctaaattgaagaaacaaacttaaaaacaactaatgagactagaatctaatgacaaatgccccatagttcttgaaacataatttttctctctagtttccaagttttactaaagacaagtcatggtaagactgatttgcttgggccgggcacggtggctcacacctgtattcccagcactttgagaggccaaggcgggcggatcacaaggtcatgagattgagaccatcctggctaacacggtgaaaccccatctccagtaaaaatccaaaaaattagccggatgtggtggcgggcacctgtagttccagctactaagggagactgaggcaggagaatggcatgaacctgggaggtggaggttgcagtgagccgagaccacgccactgcaccccagcctgggcgacagagcgagactccttctccaaaaaaaaaaaaaaaaaaaaaaaaaaagactgatttgctttattgtaattggcctgattatttgtataaagtgcagcaagaataattatttttcttttttttctttttttaattttttaattgtatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtcctcagagtgtgatgttcaccttcctgtgtccatgtgttctcattgttcagttcccacctatgagtgagaacatgcagtgtttggttttttgtccttgtgatagtttactgagaatgatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaatagtgtcacaataaacatacgtgtgcatgtgtctttatagcagcatgatttgtagtcctttgggtatatacccagtaatgggatggctgggtcaaatggtatttctagttctagatccccaaggaatcgccacactgacttccacaatggttgaactagttgacagtcccaccaacagtgtaaaagtgttcctatttctccacatcctctccagcacctgttgtttcctgactttttaatgattgccattctaactgatgtgagatggtatctcattgaggttttgatttgcatttctctgatggccagtgatggtgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtcctggcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacatggcgatgcgggctcttttttggttctatatgaactttaaagtagttttttccaattctgtgaagaaagtcattggtagcttgatggggatggcattgaatctgtaaattaccttaggcagtatggccattttcacgatattaattcttcctacccatgagcatggaatgttcttccatttgtttgtatcctcttttatttcattgagcagtggtttgtagttctccttgaagaggtccttcatgtcccttgtaagttggattcctaggtattttattctctttgaagcaattgtgaatgggatttcactcatgatttggctctctgtttgtctgttattggtgtataagaatgcttgtgatttttgtacattgattttgtaacctgagactttgctgaagttgcttatcagcttaaggagattttgggctgagacagtggggttttctagatatacaatcatgtcatctgcaaatagggataatttgacttcctcttttcctaattgaataccctttgtttccttctcctgcctaattgccctggccagaacttccaacactatgttgaataggagtggtgagagagggcatccctgtcttgtgccagttttcaaagggaatgcttccagtttttgtccattcagtatgatattggctgtgggtttatcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtacctgttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttctttttattagtcttgctagcggtctatcaattttgttgatcctttcaaaaaaccagctcctggattcattagatttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgttgtcccagagattctggtatgttgtgtctttgttctcgttggtttcaaagaacatctttatttctgtcttcatttcattatgtacccagtagtcattcaggagcaggttgttcagtttccatgtagttgagcggttttgagtgagtttcttaatcctgaattctagtttgattgcactgtggtctgagagacagtttgttataatgtctgatcttttacatttgctgaggagagctttacttccaactatgtggtcaattttggaataggtgtggtgtggtgctgaaaaaaatgtatattctgttgatttggggtggagagttctgtagatgtctattacgtccgcttggtgcagagctgagttcaattcctggctatccttgttaactttctgtctcgttgatctgtctaatgttgacagtggggtgttaaagtctcccattatcattgtgtgggagtctaagtctctttgtaggtcactgaggacttgctttatgaatctgggtgctcctgtattgggtgcatatatatttaggatagttagctcttcttgttgaattgatccctttatcattatgtaatggccttctttgtgtcttttgatctttgttggtttaaagtctgttttatcagagactaggattgcaacccctgcctttttttgttttccatttgcttggtagatcttcctctatctttttattttgggcctgtgtgtgtctctgcctgtgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctgtttattttgctcgttagttgatgcagtttcttccagccttgatggtctttacaatttggcatgattttgcagtggctggtaccagttgttcctttccatgtttagtgcttccttcaggagctcttttagggcaggcctggtggtgacaaaatctctcagtatttgcttgtctgtaaagtattttatttctccttcacttatgaagcttagtttggctggatatgaaattctgggttgaaaattcttttctttaagaatgttgaatattggctcccactctcttctggcttgtagagtttctgccaagagatccgctgttagtctgatgggcttccctttgtctctggctgcccttaacattttttccttcatttcaactttggtgaatctgacaattatgtgtcttggagttgctcttctcgaggagtatctttgtggcattctctgtattttctgaatctgattgttggcttgccttgctagattggggaagttctcctggataatatcctgcagagtgttttccaacttggttccattctccccgtcactttcaggtacaccaatcagacgtagatttggttttttcacatagtcccatatttcttggaggctttgttcatttctttttattcttttttctctaaacttcccttctcgcttcatttcattcatttcatcttccatcactgataccctttcttccagttgattgcatcagctcctgaggcttctgcattcttcacgtagttcttgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaatttgtcaaagtcattctctgtccagctttgttccgttgctggtgaggagctgtgttcctttggaggaggagaggcgctctgctttttagagtttccagtttttctgctctgttttttccccatctttgtggttttatctacttttggtctttgatgatggtgatgtacagatgggtttttggtgtggatgtccttcctgtttgttagttttccttctaacagacaggaccctcagctgcaggtctgttggagtttgctagaggtccactccagaccgtttgcctgggtatcagcagcagtggctgcagaacagcggattttcgtgaaccgcgaatgctgctgtctgatcgttcctctggaagttttgtctcagaggagtacccggccgtgtgaggtgtcagtctgcccctgctgggggtgcctcccagttaggctgctcaggggtcaggggtcagggacccacttgaggaggcagtctgcctgttctcagatctccagctgcatgctgggagaaccactgctctcttcaaagctgtcagacggggacatttaagtctgcagaggttactgctgcctttttgtttgtctgtgccctgcccccagaggtggagcctacagaggcaggcaggcctccttgagatgtggtgggctccacccagttcgagcttcccggctgctttgtttacctaagcaagcctgggcaatggtgggcacccctcccccagccgcgctgctgccttgcagtttgatctcagactgctgtgctagcaatcagtgagactccgtaggtgtaggaccctccgagccaggtgcgggatataatctcctggtgtgccgttttttaagctcatcagaaaagtgcagtattagggtgggagtgacccgattttccaggtgccatctgtcacccctttctttgactagcaaagggaactccctgaccccttgcgcttcccaaatgagggaaagatgttacaggaaatggtctcaatccagaccccaaaagagggttcttggatctcgtgcaagaaagaattcagggccagtctgtaaagtgaaaacaagtttattaggaaagtaaaggaataaaagaatggctactccatagacagagcagcccctccaggggattctgatgcacaataaggtttggtgaaagccattgaacaagatacatgtggactctgccttcatggaggctgtggaagtctttaacatatacctaatctgtcaagggtttttactttcctggtattatttgtaaatgggaagagaaagtaatgtttaatgaataattactgtgtaccagacacttgaaagcatgctctcaactttgaatattccaataacaaccttaaaatatagatgttactattcctatgtttatagacaagaagaccaagtctcaggtcttaaaacttttatatagcagagctgggatttgaatctatccttcattgcccatgccctttcttctctgttacttcttttttttttttttttttttttgagatggagtctcacttttgttgcccaggctggagtgcaatggcatgatcttggctcactgcaacctccgcctcccaggttcaagtgattctcctgcctcagcctcccgagtagctgggattacggggacccaccaccacacccagctaatttttgtatttttagtagaggcagggtttcaccatgttggccaggctggtctcgaactcctgaccttaggtgatctgcctgcccaagcctcccaaagtgctgggattacgggcatgagccactgcacctggctctactctgttacttctaaggaatgtgaatattctcaggttcttgacatatgttgccaaattgttgtctgcaagtcagtcaatgtccggtacttggaaatttccaatattcacattctctgggaagcagacttagctagagatttacacttagaaagtttagtgttcagaaagttttttagggagtactttgggaccagtactcatggaagaggaaagagagtaagcaaggttgggcagagggctaagctgggctatggtacagcctcaacaaatatttcagctgtctcctttgggtgctctgaagatagagtggcctttcagagtctttcctagtggagatgaggggctgggtcattatacattagtgatgatctgtcactaggttctgttgaccctaggaagggggtgtgcccttgggcaagatgctttctacagtagacagttccataagagggcagacagttgagggctatttaccaaaagccagtcctcccagctattgggagataagtcccaattcttgaagacagggtggcatatcactagtacagtaatatagataaaagttttttaatgatagtttagcaaacgtgaagtttttaatttatttaaattttatttattaaattgcctgtgaatgtgacactttcttcatgcatgttttatcaggtaagtgcttctttctcccttgaaaattgtaattctgcagagagggagctactgtaaatttaagctttttgtttgtttgtttgtttgaggttgagtttcgttcttgttgcctaggctggagtgcaatggcacaatctcggctcattgtaacctctgcctcctgggttcaagtgattctcctgcctcagcctcccgagtagctgggactacaggcacctgccaccacacacagctaatttttgcatggtttttttggtagaaacggggtttcaccatgttggccaggctggtctcaaacacctgacctcataatctgcccatctctacctcccaaagtgctgggattacaggtgtgagccaccacgcctggcctgcatttagtttagaggtcatcttttggaattggtactaagatgcacagaaattgaacacagatttagtaataatttctgcggttacttcactggatgttgtagagctgttatgacaactaaatcagttagatgtttaaagcacttagaccagttaatcgtgcatattgttgtaaataaacattttaaaacttactttaaaaagaaatgcagactgggcgtggtggctcatgcctgtaatcccagcacttcaggaagccaaggctgtagatcacttgaagtcaggagtttgagaccagcctgaccaacatgttgaaaccctgtctctactaaaaatacaaaaaaaattagctgggttttgtggtgcgctcctgtagccccagctacttgggaggctgagacagcagaatcgcttgaacacgggaggaagaggttgcagtgagacgaaatggcatcactccattccagcctgggtgacagagtaagactgtctcaaaaaaaaaaagaaaaagaaaaagaaatgcaattgtactaatgttctgcaaatggcttcttgtaattggagatattatttcctgtgatagcatcatacaaagatttaaaaagtattacatcttaaactgttcagatggaataaagatgatatactgtggtgggcaggataatagcctcccaaagatgtccccagaacctctgattttgctaggttacatggcaaaggggaattagaattatagatggaattaaggttgctaatcagctgattttaagattgggagagtatccggtttatccagttgggctcagtgtaatcacaagaatcattagaagtagaagctaggctagacgcagtggctcacacctgtagtcccagcactttgggaggccaagtcggatggatcacctgaggtcaggagttcaagaccagcctgaccaacatggtgaaaccctgtctctactaaaaatacaaaaaatacaaaaattagtcagatgtggtggtgcatgccaataatccgagctacttgggaggctgaggcaggagaatcgcttgaacctgggagacggaggttgcagtgagctgagatcgtgccattgcactccagcctgggtgacaagagcgaaacgtctcaaaaaaaaaaaaaaaaaaaagtagaagctagaggcagaagaggcagtgtcagtgtgacgtgagaatgtttcagctggccattgtttattctgaagatggaagagggtcatgagctaaggagtgtgcagcctctaagcctctagaagctggaaaaactttcctcatatgataaggaagctatcatgtaaaggttcatcttacatttcttgctgttttctttctttcttttgctggcaaatatcattcaggggccacagtatgggctgcagcggtgttcattgctactgggttggtcttcgtttctgggcctttttaaaggacagagctgcctctgttggattaattcctacaagtagaatagatttaaggaagatatgagtagtttttatattattattagaaaatacaaaaaagaaaaggtttcaaaaatatagaaagtagagagaataagccaggcgtggtggctcacgcctgtaatcccaacactttgggaggcaggtggatcacttggtcaagagttcgagaccagcctgggcaacatggcgaaaccctgtctctactaacagtacaaaaaaaattagctgggtgtggtagtgggtgcctgtaatcccagctacttgtgaggctgaggcaagataattgcttaaacctgggacgtggaggttgcagtgagccgagattgcaccactgcaccccagcctgggccacaaagactccatctcaaaaaaaaaaaagcgtagacaaagaaagtagagagaatagtataatggacacctgtatatgcttgtcatgtcagtttaacaattgttaacatgttaccataccatatttgcttcatttccttttttttttttttttttttttttgagatggagtcttactctgtcacccaggctggagtgcagtggtacgatctctgctcactgcaaccactgcttcccaggttcaagcggttctcctccctcagcctcccaagtagctgggattacagacttgcaccactatgcccagctaatttttatatttttagtagagatggggttttcccgtgttggccaggctggtcttgaacacctgacctgaggtgatcaacccacctcaccctctcaaagcgctgggattacagatgtgagccactgcactcggcccatctcttattttttgcttaagcattttaaattatatacggagtagcatttcattcctaaatactttacattgtaattctaaaaaaaaaatacgttttcttacaaaactgtacagtttaaattgtgattcataggttgggtatggtggctcatgcctgtaattgcagcactttgggaggctgaagagggaggattgcttgagctcaggagtttgagaccagcctaggtaacgtaacaagatccctgtctctagcaaaaataaataaataaataaataagtacataaataaaaaataaaatcagccaggcatggtggcatgtgcctgtagccccagctacttgggaagctgaaatgggaggattgcttgagcccaggaagttgagcctgcagtgaaccgtgatcgtgccactgcactccaggctgggtgacagagcaagtctctgtttcagaaaaaagaaagttgtgattcatattgtcaaattgctgaacagaattttttttttttttttttttttttttttagacagagtctcgctcttgttgcccaggctggagtgcagtggtgggatcttggctcactgcaacctccgcctcctggattcaagcaattctcctgccttagcctgccgagtagctaggattacaggcacccccctccatgcccagctaatttttgtattattggtagagatggggtttcactgtgttggccaggctgatctcgaactgctgacctcaggtgatccgcccacctcagcctcccaaagtgctgggattacatgcctgagccaccacgcctggcccagaattgttttaaatcagtaaatccagattattgaaaaacttgattctatttcacatcttggtttaattctttagtccaaagtggtgtccattctttaagattttaagatggggtagtcacatgctcttttaatctgctgtcttttaacaaaattatttgccaggcatggtgactcaggcctgtagtcccagctactgggaggctgaggtgggaggattgcttgagcccataagttcatggctgcaatgagctataatccagcctgggcaacagagtgagatgctgtctctaaaaaaattaataaaaaaaaattctgctttagcttttttcttgattaattttagacatgagtttcttagcttcccatatagagaaaaatctaatttttatcccaccatttcctgtggttacactttgtttttcaccaaaatgaaatgtttgtttataaagacttctgtagcatttatttacctactattggcttttcacattatttatatactgagttataatgctagagatattttaaaaaatagtatttaatggtcgggcgtggtggctcacgcctgtaatcccagcactttgggaggccgaggtgggtggatcacaaggtcaggagatcgagaccttcctggctaacacggtgaaaccctgtctctactaaaaatacaaacaattagcctggtgtggtggcacgtgcctgtaatcccagctacttgggaggctgaggcaggagaatcgcttgaacccaggaggtggaggttgcggtgagccgagatggcgccactgcactccagcctgggtgacagagtgagactgtctaaaaaaaatagtatttattgattatatcttattattgttgttttattgctgttcttgttccagagttttaaatgtttttttttcatttactgtattgaaatatattgaaataataatacctggagaatagagttgacacaggtagtctggtagcaaatctcttcataaagtatgtacagcagtgatgttcttttagcagttgtatacacctttcagaagaatcatgcttttatcctcctacagagcaaatagatatatatgtattttaatatggtaatgacatgatatgttttcatgttctgggagtggatgaaggaaacagctaagcttactgactgttgcctaggggaacatctaaagattgtatcaaaccaaagttcctgcctttgacagacacaccgtggtatttaggtgaaaattgtagtgtaattaagtaggtaattaagttatttatttcatttagtgatttcagggtgcatattgtagtttacttattactaggatgcagccctacttaaaatttgtaacaaattttattttatttttatttatttttttgagacggagtctcgctctgtcgctcaggctggagtgcagtggtgcaatctcagctcattgcaagctctgcccgctgggttcacgccattctcctgcctcagcctcccgagtagctggaaatacaggcgcccaccactacgcccagctacttttttgtatatttagtagagacggggtttcaccgtgttagccaggatagtctcgatctcctgacctcgtgatccacctgcctcggcctcccaaaatgctgggattacaggcgtgagccaccatgcctggcctgtaatgaattttattatagacatttgataatttttgataatttctttttttttttttttttttttttttgagacaggttgtcactctgttgcccaggctggagttcagtagtgctatcatagctcactgtaactatagcttctgcacctgggctgaagtgattctctcaccttagcctcccaagttgctgggactacagatgtgcaccaccatgcccagctaattttttgtattttttagagagcgggttttgccaggctggtgtttagcacctgggctcaagcaatctgcctgcctaggcctcccaaagtgctgggattacaggtgtgaaccaccacacctagcccttattttttgagacagagtcttgctctgtagcccagggtggagtgcagtggcatgatcatagctcactgaagcctcaacctctggggcccaagtgatcgtcccacctcagtctcctgagtagttgggattacaggcactagccaccataccttgctaattttttgttgagacaaggtcttcctatggcgcccagactggacttgaactcctgggctcaagcgatcctcctgccttggcctccgaaagtgctgggatcacaggcatgagccacagttccaggccagcttatatatttgtaatgctgattactattccattgtctggatgtaccacggtttattcttcacctactaaaggatattttgttttctggtttggggaattatgagtaaagttgctttaaacatttgtgtgcaggtttttgtgtggacataaattttcaacttatttgggtaaataccaaggaggatgatttctggattgttggattaattcttttaatttttgtgggtacatagtaggtgtatatatttatagggtacaagagagattttgatacaggcatataatacataataatcacatctaggtaaatgaggtatccatcaccatttattctctgtttgttacaaacagcccaattatacccttttagttatataaagatgcacaataaattattgttgatggtagtcaccctgtcatgctatcaaacactagatcttatttatgctatctgtatttttgtgcccattaaccattcccactctctccccctgcccagccccccagcctttagtaaccatcattctacttcttcttcttcttttttttttttttaaggtggagtctcgctctgtcgcccaggctggagtgcagtggtgccatcttggcccacagcaacctccgcctcctgggttcaagcaattcttctgcctcagcctcccaagtagctgggattacaggtgtgcaccaccacacctggctaaattttgtatttttaatggagacggggatttgccatgttggccaggctgctctcgaactcctgacctcaggtgatccacctgccttagcctcccaaagtgctgagattacagacatgagccaccgtgcccagccccgttctacttgctatctccatgagttcaattattttcatttttttagctcctgcaagtaagtgagaacatgtgaggtttgtctttctgtgcttgacttatttcatttaacataatgacctccagttccacccatgttgttgcaaatgacaggatctcattattttttaaggctggatagtattttattgtgtatgtgtttattttctttttctttttctttttttttcttttgagacagagtctcgctttgccgcccaggctggagtgcagtggagcgatctcggctcactgcaagctccgcctcctgggttcacgccattctcctgcctcagcctccgagtagctgggactacgggtgcccaccaccacgcccggctaattttttgtatttttagtagagatgggatttcaccatgttagccaggatggtctcgatctcctgacctcatgatctgcccgcctctgcctcccaaagtgctgggattacaggcgtgagccaccgtgcccggcccttatgtgtttattttctttatccattcatctgttgatggacacttaggttgattccaaaccttggctattttgaatagtgctgcagtaaacataggagtgcagatgtctcttctatatactggttttctttctttttggtatataactagcagtgggattgctggaacatatggcagttctatttttagttttttgaggaatctccaaactgttctccatagtggttgtactaatttacattcccactaacagtgtgtgagggttcccttttctctagcatttattatatcctctcttttggataaaagtccttttaactggagtgatgtgatatctcattgtagttttgatttgcatttctctgatgatcagtgatgttgagcaccttttcatgtacctgcttgccatttgtatgccttcctttgagaaatgtctattcagatcttttgcccatttcttaatcggattaatagatgtttttcccattgaattgtttgagctccttattatattctggttattaatcccttattagatgagtagtttgtaaatattttctcccattctgtgagttgtctcttcactttgttgattgtttatttatttatttatttatttatttatttttcttttgagacaagagtctcgctctgtctccaagctggagtgcagtagcgccatcttggctcactgcaacctccaccgccctggctcaagcgattcttttgccttagccttccgagtagctgggactacaggggtgcgccaccacgcccagctaatttttgtatttttagtagagacggggtttcaccacgttggccaggatggtctcaatctctttttttttttttttttttgagacggagtcttgctctgtcgcccaggctggagtgcagtggcgcgatctgggctcactgcaagctccgcctcctgggttcacgccattctcctgcttcagcctcccgagcagctgggactacgggcgcccgccaggatgcgcggctaattttttgtattttttagtagagacagggtttcaccgtggtgctagccaggatggtctcgatctcctgacctcgtgaccttgtgatccacccgctttggcctcccaaagtgctgggattacaggcgtaagccaccgcgtccggcactttgttgattgtttctttcgctatgcagaacttttgtgatggattaattatttttaattcttgtgatgtcagtgaagttgggcctgattatgattggcttttcatgtggcttgagtccatggagaataggaaacaaattaggttgaccagagtaatcaggtttgtgtgacagctttattaatcattgtgaattaataaacctgtgtgctagtgtctggttcagtcttctgtgcatttggaattttcaaattgaggctatcagggtttgttcgccctggatgtagaaagcaaaaatctggatcttacacattcctgggatctgactggtgaggtatacccttataccatgtctgtccactctcttactcatactggtttctgtagttgctcctctatcattaatgtactggccccaggggaaaagcttgctaaaccatagatattcttcgtcagacttacagctaatcacagttgaatgctggccttgctccttctgtctgctttggcttgaaaaatgacttgtgctttgcagtgtgagagaatggccttattttgtgcattcttctttgtagcatccatcaattcaacccattctgatagtttctatgatgataacatttacttctttctttttttttttttttcttttgagatggagttttgttcttgtcgcccaggttggagtacaatggtgcgatcttggctcactgcaacctacacctcctgggttccagcaattctcccaactcagcctcccaactagctgggattacaggcacccgccaccacgcccggctaatttttctatttttagtagagatggggttttgccatgttggtcaggctggtctcaaattcctgacctcaggtgatccacctgacttggcctccataagtgctgggaccataggtgtgagccaccgtgcccgggtattggaaaatgttttcttttaatgagagcatttataccatttatgttttacttaattattgataatttgggtttatatctctcatcttactacttgctttttgtttgttttgctgacattctgttcctttttttctcccttcattggatgacgatgatgattatttgtggtgttttcttttttttttttttgagacaaggtcttactccattgctcaggctggagtgcagtagcactatctgcaaattctgcctcctgggttgaagcagtcctcccacctcagccttccgagtagctgggactacagctactgtagtcccagctactcggaaggctaaggcaaaagaatcgcttgagccgggcttatttttgtagtttttgtagagatgtggtttcactatgttacctaggctgatctcaaattccagagctcaagcaatcagccagtcttggcctcccaaagtgctgggatcatgggcgtgagctcccgtgcccagccactatttcttttctttttttcttttttgagacagagtctccctctgtcactcaggctggagtgcagtggctcaaccttggctcactgcaacctccatacctcaggctcaagcgatcctcccacctcagccttctgggtagctgggatcacaggcatgcaccaccatgcccaactatttttttgtatttttagtagagacggggttttgccatgttgcctaggctggtctcgaactcctgagctcaagcaatccacccgccttcacctcccaaagtgctgggattacaggcgtgagccaccaagcctagagatgattatttttaccttgtgtttcttctccattagtttggagttgtggtggtatgatatatattggtttttgttcatggttcctggttctcaactcccatacctcttgttacagtcttttgttataatattggtgtgtcaggcctcaggaaacaggatctctctcctgccctccattctcctgccccaaggcagaactctaatcttcttccaccattctgactgtgggtcataagaccctcccggagaggctcccacccctctacactagaggcaggaatgctaatgtctttgaacttctagatagctgaatctgtgaaggttcttgcatccatggagggcttggaagctccacagcccttcccctgtacctcgccttagcacacctcttcatctagattctttgcaatattttttataataaacctgtaaatgtaagtaagtgttttcctgagttctgtgagccgctccagcaaattaatcaaatacaaagagggggctgttggaaccccagctgtttgaagctggtcggtcagaagttccagacgcccaggctagtggctggtggtctgacactatgtccagtcagatagtgtcagaattgaattggcggacacccagatggcatcccctgcttggtgtgtggggaaaacccccacacattcggtcacagaagtcatctgtgctgatcgttgtagtgtgaggaatagtgtagcagaggaaagacatggtttggagagttttaacttatgcagtagttattcattttttatttttccttacacagcagttaattttttattatttagaggtaagtctagagattaaaatatgcatctctggtttacagaaatctagtctaataattatacctccttttggacccatgaaagaccttagaacatgccatttatcaccttcctaactcatatgtgtgacattttaaccgatgtttattttaaacccgaagaactgatattattactttacattgtctgtattactttaacttcacccatatatttacccttttcttgccttttatctccccactccttgtatctttaggcttctatctggtataattttctttttccttgaagactacctttattgggtttttgctgaaattgaaggaaaaaattatttttcctcttttttttttgagatggagtctcgccctgtcgcctaggctggggtgcagtggcgtgatctcggctcactgcaacctccgccttccgggttcacgccgttctcctgtctcagcctccggagtagctggggctataggcgctcgccaccgtgcctggctaattttttgtatttttagtagagacggcgtttcactgtgttagccaggatggtctcgaactcctgacctcgtgatccgcctgcctctgcctctcaaagtgctggggttacaggcgtgagccactgtgcccagccttttttttttttgagacggaattttgctcttgttgcccaggctggagtgcagtggcatgatctcggctcactgcaacctccgcctcccgggttcaagtgattctcctgcctcagcctcccgagtagctgggattactgtcatgtgtcaccacacctggctaattttgtatttttagtagagatggggtttcttcacgttggtcaggccagtctcgaccagtctcgaattcctgacctcaggtgatccgcccactttggccttgcaaagtgctgggactacaggcgtaagccactgtgcctgggctttttttttttttttaatttttattgtagccacatacataacataaagtttgccattttaaccacttttcaatttaacattttaaattgtggtgaaatatacgtaacataaaatttaccatctgaaccagttttgaatgtacagtttagtagtaactaccctaagtatctcatataagtggaatatggtatttgtccttttatggtggcttatttctcttagtgtaatgtcctcaagggtcagttttgtttagtgtgctcaataaattttagccattcttgttttctggagtggtggtttttgttggctttttcacccagacatgctatggcatttgctgattgaagtcctgagtataaggctaacttgtccattccctcctccccaagtggtatctgtgtgatatggtttccgctgcaaattggtatttgcttgcagaaaactggagcattgcctgtatcatcatctgttactcatttggtttttcttgttctgctaggaccctggttaggagtagaatgggacaatcccgagagaggaaagcatgatgggagccacgaagggactgtgtattttaaatgcaggtaacttttcattatgaatcagcacggtcatttagtcaagattatatttaatacttgaataaggagggatggagaggaagaaatgtttggctcatggagtagttatattatggaatttgttgtattccaaaaaggcagttattttatttgtggcttaattgctgctgtttgtagcatttttcccttttttaaaaaaattctgactcttgaccttatgcatggcgttgctttcttcgtcctttttttttttttttttttttttaacagtcctttaaattggatgaatgtaaacctttctggctcattaccaatttacaatccagtaagtaaataatagaaaagagaaacagcctagatttccagtaagaaggaattgattacacaaaatacagaacatctgaatagtggaatgttgagccaccattaaataaatttcttatcataggaagagttacatgtcacattgcatttctttgtctttttttttttttttttgagacggagtctcactctgtcgcccagctggagtgcagtggcacaatctcagctcactgcaacctccacctcctaggttcaagcaattctcctgcctcagcctcctgagtagctgggattacaggtgcccacgaccacgcctggctaatttctgtacttttagtggagacgaggtttcaccatattggccaggctggtcccgaactcctgaccttgtgatccgcccgcctcagcctcccaaaatgctgggattacaggtgtgagccaccacgcccggcctgtcacattgcatttctattattatttttgatcgcctgatgtcagaaaaactgcatgaagccctgaaaagggtgctggggagccttcaggcagagcctgtcttctaaatttttgttgttgttgttgatttttattagttttcaatttctgaaaacgatctttccctagtaagctgtttttccttaagtatggtacagtgaacacaatactgccctggaaatcagggggcctctagcctgtttttaacagtcttttttgtttgtttggttggtttatttgtttattttttgagacattgtctcgcctagactggaatgcagtggcatgatcatgactcactgtcaccctgaactcctgggctcaagtgatcttcgcgcctcagtctcctgagtagctgggactacaggcgtgcaccagcacacccagctaatttaaaaaaataaaaataaaaaagagatgaagtttttctatgctgcccaggctggtctcaaactcctggcctcaagcgatcctcccacctcggcttctcaaagtgctgggattacagatgtgagccactgcaccagccccacttttaacagtctttatggtcctgaacaagacaagtttactaacctttaaaatgaaggtcagaattaggtaaccacacagcatatctcctggtccactatttcataattttagaaagtcagggtgttcttaaaaggccaactctacttgtagacttgccatctctgaatttgttcagagctgttcaggttatatggttagggagaaatattttagccaggcccacagattccttaggtacctggaccatgaccttacaaaccctccagtgaaaggacttttttcttttttttgagatgtagtctcactctgtggccaaggctggagtgcagtggcgtgatcttggctcactgcaacctccacctccctggttcaagcaattcccctgcctcagcctcctgagtagctgggatcacaggcgaacgctaccacgtctggccaatttttttgtatttttagtagagacggggatttcaccaggttggccagactgttctcgaactcctgacctcaggcagtccactggcctcggcctcccaaagtgctgggattacaggtgtgagccaccaccccctgtgaaaggactttttatttggaacttaccccagcctacttccttcttgtaaaagcttgcccaaattgtccatacttttatggtctttaatggtctctggatacagtgatattttcaaagtcttggttgctctgagcagaaaaatcaagaattgcttcaagtcctgggtgatgcagggtttgtcctgaaatgctaatgggaagccttggttcagggacattgagtcagtatagtcatgcattgcttaatgaaggggatgtgttctgagaaatgcctgttaggtggtttcatcattgtgtgaacatcatagtatacttaacaaacctgcgtggtgtagcctactgcacacctaggctactgtatggcatagcctattgcttttaggctataaacctgtacagcatgttactgtgctgaatactgtaggcaattgtaacacaatggtaagtatttatctaaacatagaaaaggtacagtaaaaataaaaaattggccgggtgcgttggctcacgcctgtaatcccagcactttgggaggccaaggcaggcggatcacgaggtcaggagttcaagaccagcctggacaatatgatgaaaccctatctctactaaaaatataaaaattagccaggcgtggtggcgggcgcctgtagtcccagctactcaggaggctgaggcaggagaattgcttgaacctgggaggtggaggttgcagtgagctgaggtcgtgccactgcactccagcctgcgtgacagagcaagactccggctcaagaaaaaaaaaaaattaagcagtgtggggtggtacgggtggtatgtgcctgttagtaccagctacttgggtggctgagtcattaggattgtttaagcccaggagtttcaagaccagcctaggcaacacaatgagatctcatcataaaaaaaaaaaagatagaaaatggtatgcctgcatagggcacttagcgtgaatggaccttgtaggactggaagttgctctgggtaagtgagtgagtggtgagtgaatgtgaaggctgggacattcttgtaccctactgtagactttggaaacactgtagccttaggctacactaaacttagaagttttttctttctttaataataaattaactttagcttcctgtaacttttttatgttataaactttaaattttttttttttttgggatggattcttgctctgtcacccaggctggtgtgcagtggcatgatctcagctcactgcactgcctgggttccaacgattctcttgccttagcctcctgagtagctgagattacaggcatgcgccaccacacctgggtaatttttgtatttttagtagagatgggatttcaccatgttggccaggctggtgtcgaacccctgacctcgtgatcaaccctcctcagcctcccaaagtgctgggattataggcgtgagccaccatgcccggtactttttttttttttttttttggagacagagtcttgctccgtcacccacgctggagtgcagtggcacaacctcggctcactgcaacctctgcctcccaggttcaagtgattctcctgcctcagtcttccgagtagctgggactacaggcgcatgtcaccatgcccagctaatttttgtatttttagtggagacggggtttcgccatgttggccattctggtctcgacctcctgatctcaggtgatctgcctgccttggcttcccaaattgctgagattataggcatgagccactgcactggacctgagccttcttccagaatacctcctgaaggacctgcctgagggtagtttacaattaactttttttttttttttttttaataagtaggagtttgctgggcacagcagctcatgcctgtaatcccagcactttgggaggctgaggcaggaggatcacctgaagtcaagagttcgggaccaccctggccaacatggttaaaccccgtctctactaaaaacagaaaaattagctgggcatggtggcatgcacctgtaatcctagctactgggaaggttgaggcatgagaatcacttgaacctgggaggtggaggttgcagtgagccaagatcacaccattgcactccagcttggtcagcagagtgaaactgtgtctcaaaaaaaaaagaaaaaatagaaggagtacactctaacataatgataaaaagtatagtatagtgaacacttaaactagtaacatagccatttattatcattatcaaatattatgtactatacataattgtatgtgctatacttttatgtgactggcagtgtagtaggcttgtttacaccagcatcaccacaaacacgagtattatgttgtactacagcattaagacagctacagcttcactaggagataggattttttcagctccagtgtgattatgggaccactgtagcatatgcggtccattgttgatctacacgtcattatgtggtgcatgactgtatttggattcttagccttggaataactgcttacttcattatatcgtctagtgttgtgttgtcatgcctaaacatttacataattgaagtacatattatcttattataaataactttttaaaatttaaataggcactttgttgacattaaaaaattatatgagtaggtaatgttatctgtgaattccatttcaggatatttatggggcaatacaaaagagatcattgggtctgaagtggtggagaaccactggtctggactacaggaatttaactggtcctttagagtttgatgatttcatgtcatgttttagtttctctgatctcttttgtaacctaaggtaaatatagtaatctcctgagctattattacccataattaatatttgtaacattagcaattaatagtggtttacagtgtcaaaataaaaataaaatgtgcagatgaatgtctaagtgtaacattttatttgggaagcaagaattgcagttcagggcatccgcacagactagatcgtctttggtatatccaaagaacaaagaacaaagagaaacgtggattttttcttttagtttttgagacggagtctcactcagtcgcccaggctggagtgcagttgcaccatctcggctcactgcaacctccgcctcccgggtccaagcgattctcctgcctcagcctcctgagtagctgggactacaggcgcctgccactacacctggctaatttttgtatttttagtagagatggggtttcaccatattggccagactggtctcgaactcctgaacttttgatctgcccacctcggcctcccaaagtgctgggattacaggcataagccactgctcctgggcttttttttttttttttttttttgagacggagtttcgctcttgttgcccaggctggagtgcaatggcgtgatctcgcctcactgcaccctccttctcccaggttcaagggattctcctgtctcagccttttgagtagctggtattataggaaagtgccaccacgcctggctaattttgtatttttagacaggatttctccatgttggtcaggctggtctcgaactcccgacctcaggtgttctgcctgccttggcctcccaaagtgctgggattataggcgtgaaccactgcacctggcccccgccttttttttttttttttggacgcagggtcttgctctgtcacccaggtagtagtacagtggcacaatcatggctcgttgcagcctcaacctcctatgctcaagcagttctcccacctcattttttgatttttttgtagagatggagactccctattttgccctggctggtctcaaactcctgggcttgagtgatcctcttacctcggcctcccaaagtgctgggattacaggtgttacccgccgtgtcctgtctagtacattttataaaaaggagaaatgttacatattgttctgaaagaaagttcattggcactagtcaagttttggagagctggctagcaagctctgattggtgagtgacagtggtgggtaagattagtcttagagtcacggcagattgttttagtagctattaaataaaactggcttcaggttacaacaggcagtctcagcagctgggcttgtaataaactgaattcttggagcaggtgttgtgtgccccgagcactttttccccttggtcccttgactctgatttagttgggtatgacaagaatgacccagtttctgtaatcaactttcccaagatttatccaagatttatggccgtgcgccagtcacccgtgtccttcctaggtactcctgctctctacttcttgttgaaggggtagttgaggggttcaaatatggtaagtaaccttgaagtcctctttaccttgtccgtagacagcagagtggttttcagttttttttttctttcaacctaaaccccagagtatgctctgaacagagctgtgtgtgtcagtattctgcccactcaccttttatttcagtgcttctgtttccaagcaatggtagaagttctcttttctggtgagaaataaatcttaaaatctgacttttcttcaacactagggagcagaatctaactttaatacttagcatcagagaggtcgtgctgttccagcctgtgtctgtggtaatggacatcttaggaaatggatggttgacaatttaagaaacaaagccctagcaataaaggataagtgtttgaaagaaaggataaatgtttgaagtgatagataccccattcaccctgatgtgattgttacacgtgtgcctgtatcaaaatattgtatgtacccacaaaaattaaaaattaaactaaaaaaagaaagcccttgatttattcatcttttgtgtgtcataagccagttgtaaagtgttttgaggatcttggctgagcattaatggattggtataaaatattctcttggtgtggtgtaaagtgttggaagatttttttttttttttaatcaggaaatgtaatgatagtatgtgggcaaggcgcatctctgttcaaaaaggtggtagctctgcttcatttttggaaggttttcttgaatcagagcaaaatcataattgtgtcaacgcaaaagcagttgagatgaatattaaattcagctgattagagaagcaaacaaaaagagcagtctacagcaaggtgcttatctactgtactgctttactcacaggaaaacaacctctctgggtcagctctttagatgttacagcgctgaacactgcacgaaagctgagttctcctctcctgatgaacagctagttatgcaaccttgctgaacactaaacattcctgaaacaaacagggtatcaagatcaacagtatttattagaaactccccagagacctggccttttccagtagcttgtatccaaagctccaacaagaaagaagcttactgtggaagtctgggagtctgttggggaccctttacctttgtgtagtgttgccagattcagcaaacaaaaataccaaatgcatagtgaactttggatttcagataaacagccaatcttttttttttttttttttagtataagtatgagacatgcatgggggcatacttacttaaaaatgatttgctgtttatctgaaatacaagcttaactgagcatcttcgattctatgtggcagtcctgatggggacataggacagaatgaatcttgataactgggttttatgagcacatgctgtttccacaagggccatgggtcaggatgatgattttaccagcagcatgtgtaattggtaggcagaaggaggaaggaacctgaacaggccaaatgcttccaagagaaacgtttttggacacccctccctgtattctcctcctcaccaacatttttctctttagacatggtttggaatttcagtgtttggatacagtttcttaatatattaatgtagaatctcagtggagtctatgtaaattattacagtttacctcttggagatttgttgttattgatgggcacccattcagctagggtttttcactatttgttgaggctgttttgttttctgagaaacctgctggaaatgttccagaaaatattgatctttagtgttagtctttgatctgtaaagggcatagcatccgttttgcaactacctaacaacattcctaactctcctttcatctgcctgcaactaaactcaacagtaataaagatctgttcatgacttcttgtttttttaccatggttttaaaacttgtttattaccactgttttaaaaagtgtagatttagggcctggcgccgtggctcatgcctgtaatcccagcactttgggaagccgaggtgggcggatcacttgaggtcaggagttcgagaccatcctatctaacacagtgaaaccccgtctctactaaaaatacaaaaaattagccaggcgtggtggcgggtgcttgtagttccagctacttgggaggctgaggcaggagaatggcgtgaacccgggagttggagattgcagtgaaccgagatcgtgccactgcactccagcctgcgtgacagagtgagactctgtctcaaacaaaaacaaaaacaaaaaaaacagaaacaaaaattagccgggcgtggtgttgcacgcctgtaatcccagctactcaggaggctgaggcaggagaattgcttcaacccgggaggctgaggcaggagaattgcttcaaccagggaggctgaggttgcagtgagccaagatcaccccactgcactccagcctgggcaacagagggagactctatctccaaaaaaaattataataaaggaataacgaatggctactccataggcagaacagtcccgaggactgctgggtgcccatttttatggttatttcttgagtatatgctaaacaaggggtggattattcatgcctccccttttaagaccatgtagggtaatttcctgacgttgccatggcatttgtaaactgtcatggtgctggtgggagtgtagcagtgaggatgaccagaggtcactctcatctccatcttggttttggtgggttttagccagcttctttactgcatgctgtttcatcagcaaggtctttaatgacctgtatcttgtaccgacctcctagttcatcctgagacttagaatgcctaacagtctggaatgcagcctggtaggtctcagccttattttacccagctcctattcaagatggagttgctctggttcaaacgtctctgacatatttcccccctcccttttacgagagaacccttaatcctaagggctgcagagggatgaagatccactttctgtaacttctttatgctgaacaggggtgatgatattcctgcctaactgttgggtctcttgcattcagggtagaggagctcagttcgaaagcgttggtatggcgaaggccattcataactcttgagttccgacaaaaggtatatctggaagattaataagtgttcagtttaagaaaacatttagtaagcttatcctgcattcctacacaaagagtataatcacagcaatatattccacaacagtaaaataaaaaaaataaaattatcccaagtaaactgaattagaaagttttccatgaactgggcaattgtttaaatcaagctaataaggagtcactagccaattccaatatgtgcccagaattagaataacattacccatcactcttgtttcttctgagcagcagccagagatcactggttggttcacaggaataagtgggatcattctcttgtcttccataggtctgtgggacacaggtcaggaactgtgtagacaaggagtgaggccagttttcccaagcggcttttattggctctataagtcaagtttgattccataaaggaacacacaccattccagttgaagccttggtaaaataagcagtttctccacttgtgtcccaaggtcacccagtcagtgctgcagactatttcctttgggttggggggcgggtcccctcagtgtcctcctttctgtggttcgccagaaagatgttaccagaaaggggtcctgatccaggccccaagagagggttctaggatcttgcaaaggaaagaatttgaggggaatccatagagtaaagtgaaagcaagtttattaagaaagtaaaggaataataaagaatggctactccataggcagagcagccagtaaactaggcttgtaacttaagagacatgtttaacttacagaaacaaatcactgatgtgtgtgtataagccatgagagagatatgggacttaattttgctacaaaagaggatttaatttcctgcataatcagcttccccctattccactgaattaatttcatcaacatacaaggtggatattttctcctgtcttaagcaatctccctcctttgacccctgtgccccttcaggacaagggtaggctgtgctcacttgcctcccagtctttggaactcaccctcgctgggctttgccctattgccccacccagactgctcgtaggaaaggttatgttcatgttgctggattcagtggcaaggcctcagctgttaccttacctgacctggttttagcattggacatggttgttgactttcttcattggcttccaggacaccacactctccaagtttcccttcccatccctttcccttcccatccctttcccttctcctccccttcccctcccctcccctccccttcccccctcccctcccctccccctcccctccccctcccctcccctccccctcccctcccctccccctccccttccctcctttcccctcccctcgtttccatctgtcgcccaggctagagtgcaatgatgtgatctcagctcattgcaagcttcacctcctgggctcaagcaattctcttgcctcatacttccaagtagcgaaactccaggtaccagcaaccatgcctggctaatttttgtatttttaatagaggcagggtttcaccatgttgaccaggctggtctcaaactcctgactttaggtgatctgcccacctcagcctcccaaaatgctaggatcataggggtgagctaccgcacctgatctcaaactcctgactttaggtgatctgcccgcctcagcctcccaaaatgctaggattataggggtgagctaccgcacccagcccacactctctaagtttctaactccctcctggccacttcttcccaggttggggattggttttaactttttgggatcacaagttccttttagagtctgatcatcactgtgaacccacatcttagagaaaactgtacgtatgtttatgttaacaaaatttatcacaaatattagttttcatccttttcaattattattattattatttttttgagatggagttttgctcttgttgcccaggctggagtgcaatggcatgatcttggctcaccgcaacctctgcctcccgggttcaagtgattctcctgcctcagcctccccagtagctgggattataggcatgtgccaccacacctggctaattttgtatttttagtagagatggggtttcttcatgttggtcaggctgatctcgaactcctgaccttaggtgatccgcccttttcagcctcccaaagtgctgggattataggcatgagctactgtgcctggccagaattatggtgacttctaaaaaggtctgatttctttctttaagagttaatggttgttgcctgggcaacgtagtgagatgttgtctcttaaaaaaagtacgaaaagtgttagctggacatggttgcttgtacctgtagtcctagctacgtgggaggctgaagagggagcattgcctgagccctgggaattggaggctgcagttagttatggttgtgtcactgcactctcaccgaggtgacagagtgagaccccctttctttaaaaaaaaaaaaaaaaaattaggcgtggtggctcacgcctgtaatcccagcactttgggaggtcaaggcgggaggatcacttaaggtcagaagttcaagaccagcctggccaacatggtgaaaccctgtctctcctaaaaatagaaaaattagcctgggtgtagtggcacatgcctgtagtcccagctaattgggaggctgaggcaggagaactgcttgaacccaggaggtggaggttgcagtgagtcaagattgcgccactgcactccagtctgggcaatagagtgagattctgtctcaaaaaaaaaaaagaaaaaaagtaatgatcgtaagctgaaatagtgtttataatacaattttgatcaatttatagagttcactgtttcttctttttttttaagtgacaaggtctctctctgttaccaaaataaaaaataaataagtaaataaataaataaatgattttgtatataatccacctacgatttttttttttttttttttttttttagatggagtcttgctctgtcacccaggctggagtgcagtggcatgatcttggctcactgcaacctccacttcccgagttcaaacaattctcccgccttagcctccctagtagctgggactacaggtgtgcaccaccacgctggactaatttttgtatttttagtagagatgggggtttcgccatgttggccaggctggtcttgaactcctgacctcaggtggtcctcctgccttggcctcccaaagtgctgggattacagtcatgagccaccgtgcctggccacccccatggatttaatacttctgttttttctaatgtgaattgtcagtttcatattacttgttagtttatttaaagggatttaacatgcttgcataagatcataaccctttatggtcaatcatactgattatatattattttagtatgtgatattctcttttatgctaattttgattttttagcatgtagaaatttttgaagaccttcagaaaattgtatttatggcctttcttggtgggtaatattttctgtgtttcatttgctcttctttaccaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaaggtaagtggagtttataacggcagagctgacttttatggttttattaaggttcagaattgaaatacccatgactgtatatggatgctcatgactttgctcctaaactggtttatggttccacagaaacggaatcaaaatctgaggaatccaagaattatttagggaaattaaaattcttatgttagcacaggattggtagatttatccagtttgcaattgaaatatttattggcccattattactattcacatcatattatctcgtgttgactaagtaaccaaggctgacgtttgggttcttttctatttcatggtgatgatggtaagttgggaatggaaacagcagtctgaattgttccctatgccgtggagcgtgctggtgccgtctgttaatagtagggagtagttctcacctcgggctgcacatcttcatcacctggggagctgtggaacatgcggcatccttggtcccatcccagatctgctcaatcacaattttgggatatgggctctaatgcattttattgtattgtattgtattgtatttttatttttatacagacaggatcttgctatgttgcccaggctggtcttgaactcttgggctcaagtgatccttggcttcccaaagcactggggattacagggattaagcacccggccttaaaataatgccctttaaaactgctgcacaagaacattctcttttctctgaaactgtatattgtgactttgtacaaggaggctttctagtcattccagtgaactgcttgaatcaaagagagagaaagatagtatttacacaaaaccagtcatggctgcacaagaactggccaggccttgcagcttcctactgtggtgagtgacttggacgaggcatctgggtaaggacccctggtggccactgtgaggataaatttgtggccacttggaggcctgcaatatattttctttcagtctctaaaagaattaagctatagttctgtccaaagtaaatttctttactatcttttgttattgttgttattaataaaagtgcacatggggacaatgtggaaaataaatacatttcttggtacatctactctttagcatacatggcccccattaaaaaaaactcagaataaatcaagagttttagaaaaaggaacaaatggactgttctttataaaacaagatacctttattgttgagaatttagaaattacagattgaacaaaaaagtatcatgattaatgccaccacttagatataagtatcgtaaacgggctgggtgcggtggcttatgcttgtcatcttagcacttttggaggccgaggcagttggatcacttaaggccaggaatttgagactagcctggccaacatggtgaaaccctgtctctactaaaaatacaaacaattagctgggtgtggtggtacgcacctgtagtcccagctgcttgggaggctgaggcaagagaatcgcttgaacctgggaggtggacgttgcagtgagccgagatcatgccgctgcactccagcctgggtgacagaatgagactctgtctcaaaaaaaaaaaaaaaaaagaaaaaaaagacgtaactatcatgaacagtttttactgtttaccctactgatttacttggatttaaagaactacatgcttcatagggttagagttctttgctttattttttcccatttaaaatacaaatagcctgggcaacatggcaaaaccctgtctctacaaaaaaaataaataaataaatgcaaaaattagctgggtgtagtggtgcgtgcctatagtcccaactatttgggaagctgaggtgggaagatcacctgaacccagaaggtcaaggctgcagtgagacatgattgcaccactgcactccagcctaggtgacatagtgagaccttgtctcaaatgacacacaaaccaaaaaaaaaaaaccccaaatatttacatatctcttacccaaaggaagcatttttttaattggttaatctctttctgagaatattaacaaattgcaaatggattttcgtcccctagtttatgaacagctatgtaactcatgaatttttctgtaaatgaccctactacttgagtatcattgcatttaatcattagctagtgtctttcttgattgaaaaggtaaaattttagagattctggagtaatctcatatgttggctggagattagtcaattcagaaattatgagacagcttggtggaatgcagccagtgttggagttaggctgggttcagccgccagctaaggcacttttggctctgacagaagttagagatagctgcttattgtttctaagcctcagtttcctcagttacaacataaaacctaagatataagtgctgttgtgaataacaaatgagatcctacaattaatgatagctgtcagttaggagttgaaacctctactttaagccattgtcttatctcatcaataaaatccagctgaccagctttgagatcgtaccactaagaagagacttactcaataaaggaatcaaaaacaaattaaaaaatccattatgtatggtttctcttggagatggctttggctctggagtgatgcttggactgagatctgagtcctcatgcttagtgccaagttgacctggcaaagaaggctattttaaattttagggggaaggagcgacatctgtcggacacagtgcaaactacagtttgaagtagttgcctgtttcatgagattcctgtagttcttttcaatgatgtcataagcctacaaagctggcttttgggcaattgccgcgataaaacacaagtatttatgtacatctatcatgcatcaatagaaatatttgttttataaaaaagcaagtatctcttaaatcagtgtggaactggaaatggaattggtggcgtccagtctgattccagggtttgggaagttgggcagtgcccagcagacactgagttgacaggacataagtaatgattaagttgtttggccctaactacgtacttaattggaactgtgaggtatttattttggcctaagtaccatgaaaaaaattactgaaaccctaaggaccgtgtggcctgagaaagtttgggaccctctaaccttgaattctgctgctgccttttgtaccctggtttttctttcttttttttgttgttgtttcttgttttttgttttgagacagagtttcactcttgttacccaggctggagcgcaatggtgtgatctcggctcactgcaacctccaccctcccgggttcaagcgattcccctgtctcagcctcctgagtagtcgggattacaggtgccccccactatgccaggctaatttttgttattttttttagtagagacagggtttcaccatgttggccaggctggtctcgaactcctgaccccaggtgatccgcccaccttggcctcccaaagtgctgggattacaggcataagccactgcccccggccatgtatttgttcttctgtgactggcttatttcacctagcataatacactcaaggttcatccacattgcggcatatgtcagaatttccttccttttttttaagttcgcacaatattgcattgtatatgtgtgccacgttttgtttatcctttcatttgttgatggacacttgggttgcttccacctcttgactaccaggaataatgctgctgtgaacttgtgcatataccgtggccttttagagatgtgaagtctgaggcacagaggtgctaattcacttctccaaagccaaaggagatggtggaattgggatttgaacccaggtggtctggttccagattctgtgttcttagacattatgtatgcggattcttttcatgaatagaaagcacaagattctctacacttaacaaatggctgccggaagtatctggtcatgctgaagctgggtgcgctctctaggaagtaccttagggaggcttttacatgtgagtgcgagaagcactccatagcatgtacttctgcgtggttgggaacaatctaaatgtcagcagaagagtatgtacattccttgtggtctgttcatataacaaacgctgtaaggtgtgaagatgaatgtcctggagctccatgtgtcaccgtagtgaaatctcaccactgaacaatagactgttgaggaaaaagtcaggtgcagaaggctctgcggagtagaataccatttatatcaagtttcagaatattaaaaaatgctgtaattgtttagggatatggaaatatatggtaaaaatattaagaaatgcttaagattaaataaacaccaaatgtagtataaggccctggggagggccgggcgtggtggctcacgcctgtaatcccagcactttgggaggcggaggtgggtggatcacttgaggtcaggagttcgagaccagtctggccaacatggtgaaaccccgtctctactaaaaacacaaaaattagccaggtgtggtagcaagcgcctgtaatcccagctactggggaggctgaggcaggagaatcacctgaacctgggagggagaggttgcagtgagtctagattgtgccactgcactccagcctgggcaacacaacgagactctggctaaaaagcaaaaagaaaagtttacctctgggagtagagggagaattgtgtttggagagggccccagaggacttcagttgcatttgtaatatttgtagtgctctttttcttttttgtaatgctttatttcttaatttgggtggtggttactggtatttgtatattatttttggtacccttttatatgtctgaaatgtgtttaattttttaaagggccagtggatagcatacgtgcttatgtatccatgtgaactctgtttttcatgcagtcagctgagcaagttgcaagaagtttctctgaggaactgtgcagtaagttgtgctggtgaaaaaggaggagttgctgaagcatgtcctagtatccttttcaccgagagcttgttattggaatctgactatggattttatacctgtgccagagactgctaattgcctacccattgtccagtcttgacaacttccttcctaatgcagttcagttttgcttggtgtagttggggcccagataaattatttaccttcccagacccctttgcttgcaagtttgccagcatgttcaggtggaagtttctacaccgggctccttgaaagggggcacacttggccaggcgcagtggctcacgcctgtaatcctagcattttgggaggctgaggcaggtggatcacgaggttaggagatcgagaacatcctggccaacatggtgaaacctgtctctactaaaaatacaaaaattagccgggtgtggtggcgtgtgcctgtagtcccagccactcaggaggctgaggcaggagaattgcttgaacccgctaggcggaggttgcagtgagctgagatcgcgccagtgcactcagcctggagacagaacaagacttcatctcaaaaaaaaagaaagggggcacacttgtttggcctctgccttttgcctgttgcttttacccttcccctgccttgagcggatggaaagcccagggctttggcagctgtcttacaagtgtgaagaaagccatccagtacagattgggagagcagaggagagggaacctgggctgctgactgtgtactgggaacctaagatgaatctgcttcagccctggtctgttttctcatgcagttcttttttttttttttgagatggagtcttgctctgttgcctaggctggagtgctgtggcgtgatctcagctcactgtaacttccgcctcccaggttcaagtgattcttctgccctagcctcccaagtagctgggattacaggtgcccgccaccatgtctggctaattttttttttttttttttttgagacggagtctcgctctgttgccaggctgcagtgcagtggcgtgatctcagctcactgcaacctccgcctcccgggttcaagcaattctcctgcctcagcctcccaagtagctggggctacaggcgcccgccaccacgcccagctaatttttgtatttttggtagagacggggtttcaccatgttggccaggatggtcttgatctcttgacctggtcatccgcccaccttggcctcccagagtgctggaattacaggcgtgagccaccacgcctggcctcgtctggctaatttttgtatttttagtagagatggggtttcgccacattggcgaggctggtcacgaactcctgacctcaggtgattcccctgcctcggcctcccaaagtgctgagattataggtgtgagccacatacctggcctcatgcagttattttttagtgggaaagactctggttctgtttcatgcagctgaatgcagtttgttataataccccaacagaggctctttatgaagtttggaatctcttttctctacctgctcttattagtgttatttttgtcatatatttcttttttgcctgtaagcaaaaatgttggaggtaggttaaaagaaaattttaaggatgggcatggtggctcatgctggtaatctcagcatggtaatctcagcattgggaggctgagactggaggactgtttgagaccagccttggcaacattgccagaccttgtctctataaaaaattaaacaaagcaaaacaaaactgggtgtggtggcatgtgcctgtcatctcagctactcgggaggctgaggtgggaggactgcttgagcccaggagtttgaggctgtgatgagccatgatcatgccactgtacttcagcctgggagaccccgtttctattaagaaatttcccatggaggctgggcgcagtggctcatgcctgtaatcccagtactttgggaggccgaggtgggcggatcatctgaggtcaggagtttgagaccaacctggccaacctggtgaaactccatctctactaaaaatacaaaaattagccaggcatggtggtgcatgcctgtaatcccagctacttgggaggctgaggcagggagaattgcttgaacccgggaggcggaggttgcagtgagtgaggtcatgccattgcactccagcctgggtaacagagtgagactctgtttcaaaaaaaaagaaagaaatttcccatggaaaccaaatagactttctttaactttaaaaggtctttccccaattcattaagtctgtctgatctgtacataataacttttgcaaaaaatagcagttttgatcagtttttttctgagtgaagagatgccaggtgaagtagctctctttggcaaaatgccccgacagtgcagtgaaggaaattagatcagacatctctccatctgtgtgtctgagggttcacttcccttgggggaaacagtctgggggtctgttgggacctgtggtagctgcacaggtctctgcctgtctctgccagtctctgcccctgagcagcctcctccgttgaccccagcgtgctgcaaatatgaggtcattttcaaaagtaggcagctggagtgaggggaattgaagtggatgcagaaaagagtttgctgaggagccagtgccacagcagtgtcagagcattctgcattctgcctggcctattcctaaactatttcagaagattggtaatcgggctgtgtacagtggctcatgcctgtaatcccagcactctgggaggccaaggcgggtggatcacctgaggtcaggagttcaagaccagcctggccaacatggtgaaaccttgtctgtactaaaaatacaaaaaattaactgggtatggttacggacgcctctaatcccagctactcaggaggaggctgaggcaggataatcacttgaacccgggaggcagagattgcagtgagccgagatcacaccactgtgctctagcctgggtgacagagcaggactccatctcaaaaaaaaaaaccaaaaaacaaaaaacgggggggccaggtgtggtggctcacgcctgtaattccagcactttgggaggctgaggcaggtggatcacctaaggtcaggagttcgagaccagcctggccaacgcggtgaaaccccatctctactaaagtacaaaaattagccaggcatggtggtgggcgcctgtagtcccagctacttgggaagctgaggcaggagaatcgcttgaacctgggaggcagaggttgcagtgagccgagatcgcgccattgcactccagcctgggcgacaagagcgagactccgtctcaaaaaaaaggacagatgtggcggtaaatgggtttgggagtgctggctgttgggttgctcagagctgtcagcagtgtcctgaagaatcagcatgttgtttgtttatactgcacttttctggagaaaaatgtcccccaggacacgaagaaatgaggtttcacgaagataatcaagtcatgattggtatttgcagatacagtgataaatgtcttgcagctcccgattgaattctcgccagaagttgaagtattgctttgggtgcttaatccagtcatccttttttgggttggtctgtctttgaggttatttactctaccagaactcgaggcagtgggagagctgcagacccgggtgtgtcaaatctgagggtacttccaggggaggggatgagcttcctcctccctcatgacctgcggaggagagtctgtgcccaggtgcttggcctgtgctttcacgggggctccttgaacggtgtgtgtgggaggggcgaccacatattgacagctgttgttcgtggttgatttcaggatgtaggtggtctgtgtgctctgtacagaccttagaaacaataactctaggctacataatgggaagcagcagtgagggaagcgtgattggacttaaacccttcctcagcagcctaacagccgatttagcggggttaatggaaacacagggtggccaaagtgtcacccagaggccgggaaagcacccctcgcatgagcctgtgttaggcggtgtcaggaagctagggcagccgagaggaggctgaggaggaggggcagaggagcagtttacagaagccatcatgcaggtgtgggcccaagggcagaggaggagcgcgaggggacctggagggtgtttgcccggtctggaattttcggcagcctgcaccgactcttttcccttccatttgatgcgacggccacggcaaaattgaggctattctgcaggtactcatattaccgattgaaatgcaactgtttacgagggtagaccccattgttagctcttgggctgtaatagtccaggcagctggcaggattcgggcatgggtagctggcgaccgggtatggagtcatccctttcttcgcatcttctctgccgtccttcccttgttcctgaccttcttgcagagcttcctaattggttcctgcctaaaattatttcctttctaaccaatgctttggagtgatgccactgtttttgtaaagaaactttctccacgttttatgtatgtttgatgactccctgttgcattatggggtgcaatgatatggattttggatcgaggatgacttgggtgtaacttcccacttgttcatttgcacacaatgacacagctctgtgactgctgtgccaccgtttgttctgctatgagaaagcaaaacaacccagcaatcagcatagtgcctgggtctggttagcagtggcagcagcagtgcgggtggtggctgtcactgctgctgttgttattactggatcttagagctcttttttttttttttttttttggagatggagtcttgctctttcactgggctggagtgcagtggcgcgatcttggctcaccgcaaccttctggcacccaggttcaaggattcttctgcctcagccccctgagtagctgggaccacagatacgtgccaccacgcttggctgattttgtttttgttttttttttttctttttttgagatagagtttcgttcttgttgcccaggctggagtgcaatggcatgatcttggctcactgttacctccgcctcccaggttcaagcgattctcctgcctcagcttcccgagtagctgggattacagacatgtgccaccatgcctggctaattttgtatttttagtagggatggggtttctccatgttggtcaggctggtctcgaacccccgacctcaggtgatccgcccgcctcggccacccaacgtgctgggattataggtatgagccacagttcccggtccaatttttgtatctttagtagagacagggtttcaccgtgttggccaggctggtctcgaactcctgacctcaggtgatccgcccactttggcctctcaaagtgctgggattacaggcgtgagccgccgcgcctggcctggatcttggagctcttcttctgtcgctggccactcctcagtcgcttctgtgggacctttctctggttgcagactgttgggtgtaccccaaggctcagacttgggagccctgggcttcttgagagaccttctggggtgtggctggcactcctccacggcctgccctcttccacatctgtctctccagctgcagctttgatacctctgtctggatgtctcatagccatcatagatttagcatgtccaaaactaagacccacgcctgctcatcctgtagtcttttccctcttaataaatgacagttccatttgcacaggccacagatcttggagttgtccttgacactccctttctcccatgccccacacctaaatccattggcaaatcctgtgagccccacttccagagtcagacgccccctctgacatgttctgccctctcatgctgctggtttgctccggcctcctggagactcccggccctcctttatttccctgcaattgtgctcaactcagaagcacagtgacttttactggatttttttgttgttgttgttttgttttttgacataatatagatcaaagtcaaagcagagtgatttttaaaggacccaggtcacctgtcgctgtttcaaagcctccaatatctcccgtttcaagcaaactttgaaaagtccgtttcaaacagactttgaagtggcctgcaaggccctttgtgatgtggcctggccccttattccttgtgaccttgtttctagtacccccaagcccctctgctcgagtcacacaggcgctggcggtcccggtcataggctgagctcgttcccaccccagggccttttgctcttgtcactcctccgccatgtgctcctctcccagatggcgttcccccatttccctcagctctctgctcagatgccctcttagaggaggtggtcttccctgggcactgcatatagaacagccacacacctttcctgcatgccctgctctgtccctgagcacagacaggcctgcctgtgacacactgttgaggcccctgtgtcgtgatcgtctctccccgatgacactctgctttgctcactgcgatgctcctggccctaaataattacttgcagaatagacgagtgcattgaataatttccacacatacacatattagatgagagtgtagctcctccagtagctggcccggtcctgctgcaagctcctctgtctttctctgcggggacctggctaagctgtgccccttcctgatggtgctgcacctgcacctagcccctcacctccacttgtgttgtctgtcggctttgcttttccagccccactgtgttatcctctctgaatccctgtatcaggggcagttggagtgatactgttacaactgcttccaggctaccggacaccctctcaattcctaagtcatgcgcttttgcacatgtgtcccaagttgacccctcttctctgccctgtagatgctatttatctggagattcctatggtaatggtgccccatagaaggtcatgtgctggggtgaggcttgtgtgtataccttaggtgcttcagaaatcaaagttaccctcactgcttttcccctctccttttgttggatagtgctaggatggtttagcgttatgacatttggttctttgtcatttgattgtagatgtttgtctcaagttttgagtatataacaatgaacttttaatttatttttagttttttgagacagtctcactctgtcacccaggctggagtgcagtggcgcagtctccactcactgcaacctccgcctcccgggctctagagtttctcttgccttaacctcctgagtagctggaattacgagcgcgtgccaccacacctggttaatttctgtatttttagtagaatggggttttgccatgtgggccaggctggtcttgaactcctgacctcaagtgattcccccgaccttggcatcccaaagtgccgggattacaggcgtgagccaccgcgcctggcctcacaatgaactttttcgtttctcagtgaagttttggataacttaaaaatattatgtactcctgaaaaaatttgaagctgactagagggtataaaatgaaaagttaaaacgctcatgctctggaattaagagtaactccttttatgtcttttgtgaatcttttgaaattactgtttcttaacatgtgcttttagatatcagaaaggtagatttgtcaaaaaacctgttgtcatcatgggatgaagtgatacacattgctgatcagctcagacacctggaagtccttaatgtcaggtatgaactcttggttgctgaatcttcattaacaataaagctcatctctccttgcttcctcacagcatctctgtggaaagaggtagggagccggaagggttaaggctgccacctgatgatacaggagttaagaaggaattactcaggctgatagtgagggtatggaagtcctcagtaaggttttccttttaatgaaaagcagccccaaattattttcctttctaacacaagcagcctgtaaaatcgagctgcagacatagatgcagacagttgagccaatcaggttcaagatggcagctccatcttcccttctcttttccagccacgtgtacagtaaggagcagacaagatggtgccagccaaagggaaatttcatttacatagtaagattagggtggggtggccagcctttcctggctgtgtaaatgtcatgcctgattgaaccaatctgtgagcattaagtaaatcagacactgcctcctcaagtcaaactaaaatctgtgcatctgggccgggtgcagtggctcactcctgtaatcccagcattttgggagtctgaggcaggcggatcacctgaggtaaggagtttgagaccagcctgaccaacatggagaaaccccgtctctactaaaaatacaaaattagctgggcgtggtggcatgcaactgtagtcccagctactcaggaggctgagacaagataattgcttgaacccgggaggcagaggttgcagtgagctgagatcgtgccattgcactccagcctgggtgatagagcaagactccgtcaaaaaaacaaacaagggccaggcgcagtggctcacgcctggaatcccaacactttgggaggctgaggcgggcggatcatgaggtcaggagatcgagaccatcatagctaacaaagtgaaaccccatctctactaaaaatacaaaaaattagccgggcgtggtggtgggcacctgtagtcccagctcctcgggaggctgaggcaggagaatggcatgaacctgggaggcggagcttgcagtgagccgagattgtgccactgcactccagcctgggcgacagagcgagactccatctcagaaaacaaacaaacaaacaaaaaatctgcatctgctgccagcttgcctttttcttcttggaagtcccctctctcttactagagagagagctgttttccatcttctttctcttgccttttaaacctctgctcctaaactcctcatgtgtctgtgtcctaaattttcctggtgggagaagaggaataccaggtgtataccccagacaacgcagctgcttcgctagtagacatttttatacagccagattttggtttacttgaatttatctaactttaactttaaggacacatttaatctttaaggacactttatttatttatttatttatttatttatttgagacagtgtctcgccctgtcgccaggctggagtgcagtggcgtgatcttggctcactgcaacctctgcctcccgggtttgagcgattctgctgcctcagcctcctgagtagctgggactacaggcacgagccaccacgcccaactaatttttgtgtttttactagagacggggtttcactatgttggctaggatagtctcaatctcttgaccttgtgatccgcccacatcagcctcccaaagtgctgggattacagtgtgagccactgtgcccagccttatgtatgtatgtatatatgtatgtgtgtatatatatatatatattttttttttttttttttttgagacagagtctcactcttgtcgcccaggctggagtgcaatggcgcgatctcggctcactgcagcttccccttcccgggttcaagggattctcctgcctcagtctcctgagtagctgggactatgggtgcccaccaccactgccagctactttttgtatttttagtagatgcagggtttcgccatgttggccaggctgttcttgaactcctgacctcaggttttccacccacctcggcctcccaaagtgctggaattacaggtgtgagccaccatgtcccgcctctttaaggacactttaatctttaagggcacattgattattatagccttgcaaacggtcacatgaggtgattcatgaataaggaatgtgttttaacttttaccaggtggggatgagttagattttcattgaactgcaagatcttatttttagcctgaccgtaaagatggaaggttgggggaggtgatatttaattggggagtaggagaggagaggtgatattattaaaactgcttgtttatttgaaaacttctagcgtttaattgctgtaggaatgagtaatttcattgggatactgtttaattctgttttgataaggatttttcattaatctacctattttactaatgtcacacttttctaggccttcctgaatatttaatttgttttaatctcagaacctaactttccaagggcttagccaggcttcctccatttttttttttttgaggcagagtctcactctgttgcccaggctggagtacagtggtatgatcttggctcactgcaaccttcgcctcccagattcaagtgattctcctgcctcagcctcccaagtagctgggactagaggtgcctaccaccacacccggctaatttttatatttttagtagagacggggtttcatcatgttggccaggctagtcttgaactcctgacctcaggtgatccatctgccttggcctcccaaagtgctgggattacaggcgtgagctaccgtgcccagcacaggtttcccctttcattcttgaaccatttttgcatagacatgtgagtgtacagtaaagccggtagacaggcctgaatgagttgtgctcccaaatagagcaaacgggggcaattcaacccatggtgtctcatcttctggaaatacgggcttgtgttttttaatagtatcgtctttcaaagtgactgtcaggattgaatactttctgagattagggttttgagaaataatttaaggggcaataatttcatccatcctcatagccaaagggcagactctatgtttagagaagcaaaattctagcccatgattcagtgtatcagtaagactctggagaacgggactttgttttgcagtatccagagccatatcttgtgaagctggaagctcaccttgcaaatgcctgagttttgggtttaggaagcctacagccgcatacaggtgccctaatcctgtgaaagcatctttacacagctgataccaaaaagttgtatgttgtaaatgttaaaaattaggtagtcttgattcacttgaatcattaaaaaagtgatttttaaaatataattccattttaagattgaaacaaatcaaaccccttagattaaaacccagattgttgctttcaacaactatttcagttgggtttactgtatagaaataagtacattgtatcttttttttctacacagtgaaaataaactaaaatttccctccggttcagtattaactggaacgctttctgtactgaaggttttagtcctcaatcaaacaggaataacgtgggctgaggtaatcatatttctttgttttattacacattaataagcaattaaaaatgtttggtttaatagagaattgttagtacagtttaatagtacaactgtggcttcatttaaatcatcccagtatctattaatagataacaagattcattaaagtgccttataaaaacgagttaaaagagcatcatagttgagttttgcatctggaaatccatgtcctatctcagctcattttgacttgttctggtgcctttataaacagtggcgctccgttatggtatgaaccagtatgtgctgagcttcaaaaagccgtagtgttggctattgactagcttcctgagttttcctgttagttttttttagaacagaagccaagcagcagaaaggttctcacatacttttcttgttagaagttcggctcttggaatccactgttcattttatacagccgggctcaaaagtagacttgtgggtccttggcacagcagcatttgggacttatatctggcagtactatttcctgtctgaggtgtactgacttcacacacccagagcattccactttctttttttttttttttgagacggagttttactcttgttgcccaggctagagtgcaatggtgcaaccttggctcactgcaacctttgcctcccaggttcaagcgattctcccacctcagcctcccaagtagctgggattacaggcatgtgccatcacacccagctaattttgcatttttagtagagacatggtttctccatgttggtcaggctggtctcgaactcctgacctcaagtgatttgcccgcctcggcctcccaaagtgctgggattagaggtgtaagccaccgtgcccagcccactttcatttttatttatttatttttcttgagacagagtctcactctgttgcccaaggtggagtgcagtggcgcaatctcggctcactgcaacctccgcctcccaggttcaagtgattcttccgcgtcagcctctcaggtagctgggattacaggcatgtaccaccatgcccagctaattttgtatctttagtagagacagagtttctccatgttggtcaggctggtctcgaactcctgacttcaggtgatccacccacctcggcctgctaaagtcctgggattacaggcgtgagccaccgtgcccagcccactttcatttttatttatttatttttcttgagacagagtctcgctctgttgcccaagttggagtgcagtggcatgatctcggctcactgcaacctccgtctcctgggttcaagcaattctccagcctcagcctccaaagtagctgggattacaggcgcttgccaccatgcccagcttatttttgtatttttagtagggacagggtttcaccatgttggccaggatggtcttgaactcctgacctcaaatgatctgcctgtctcagcctcccaaaatgctgggattacaggcgtgagccactgtgcccagcttgggcattccactttcaaaccaagggtgtagaaatacattcccagccatgttcacccaggaagtgccacagaggccactcagtgagagacaggtgggccccttgtgcccttaatatgcccgtggccatggagcctctttcctagggcccctcctctgtgaggcgcttactccctctcaaggtgtagatgtagctggaagacaagaaggggccagacactggcactggggctcacacctgcaatcccagcgctttgggaggctgaggtgggaggatcacttgagcccaggagtttgaggctgcagtgagctaggattgcacctttgcactccagcctgggtgacagagcaagacgcatctcaccctccaaataaactaggaagggcacacagaaattgaagtggtggagatggcagtaaagttccagtgagaaaatttagaaatagttggtgaggctggtcatggtggctctcgcctataattccagccagcactttgagaggcccaggcaggagaatcacttgaggccaggagttcaagacccacctaggcaacatagagagatcctgtagatgctatatatatattatatattattatacataattatataatatataataattttttgtaatttttttttttgtaaaaaaaaaaaattaggctcatgcgcagtgtggtggcagcaggcacggtctcgacatgcagaaagacgccagcaagttcgtggatctgtgcgtgctgcagaaatgctccaccagcaactgcatcatcagtgccaaggaccacacatccatgcggatgaacgtggccaaggccagtgaggtcacgggcaggtttaacagccagtttaaaacctgtgctatctgcaggactgtttgcaggatgggtgagtcagatgattccattctctaattggccatggccaagggcgtcatctcaactatttggtttttgagatggagtcttgctctgttgcctaggctggagtgcagtggtgtgatattggctcactgcaacctctgcctcctgggccaaaatgattctcctgcgtcagcctcccaagtagctgggattacagacgtgcactaccacgcctggctaattttttgtatttttagtagagatgggttttcaccacgttggccaggctgttctcaaactcccgacctcaagcattctgtctgcctcagcctcccaaagtgctgggattacaggcgtgtgcaaccatacccggccatttttgtatttttagtggtaatgggtttcatcatgttggccaggctggtctccaactcctgacctcaagtgatccacctgccttggcctcccaaagtgctgggattacaggcatgaactcactgtgcccgatctcaaagaacttttgattggagagaatcatggatgtagaatatttgtcataaatatataatgaaaactttaaaaaatgtataattaaaaaaataatgaaagaagaaataattgttgagaaatttatgaaaggatatgaaaaattagcatatcctttacaaacccagattggcatttagaattgaggaaaggtgtgtaacatcaatttacttattttggttaagcaaattctatcaaataataatatgtgcagttagtatctcctgttccacctcgtagctgctttacctaaaccatgcattgacacgtacctccaaggcctcaaagtgcccacagtgtgtgctcccacagcattaaaatgcacccccttaacattttatttatcaccccccaccactattccaggcctgaaacagtcttatgaactgtccgtgaggcacttgtttgctgaaacagtaactgagctgaattcttgtggtggttcctatgaacacccgggaagaaacagccagcagaggccgcctgagcctgaaccgagtttctcttccaggtgctgcggtgtgtcgcggggtgcccaggcctggaggaactctaccttgagtctaacaacattttcatttccgaaaggtaactagcacttacttaaatgcatctatccccatttaatcatcattctgagtaaataaatggtctcaattatatctaaccttaatttttagaaggatttgcaaacaagaattaggaaaaatgcttattattcattgccttcacaaattagaatttcactaattggttctaatcaaaggaaactcatcagaattaaatatttgtgaagacatgagttatattagttttgcatcagtgtattaacttgctgtttcttttttttctttttctttttttgagacagagtctcactctgtcgcccaggctggagtgcagtggcgatcttggctcactgtaacctccgcctcctgagttcaagcgattcttctgcctcagcctcccgagtagctgggattataggtgcctgccaccatgcccggctaattttctttatttttagtagagacggggtttcaccatcttttacggggtttcaccatcttggccaggctggtctcgaactcctgaccttgtgagccactgtgcctggccaacttgctgtttctaaatggaagttctgtaggatatgctataaggattaaataatgtatttttcattagcatcatctgtttaaggtcattgtaccaaagtacatgtaaaactttgttctctgaaatatattgttgcctcatctcctttttaaattaataatattaaattactatgtaaaattaacctaactgtgggaaaatttacaacagattctgaattaaaggattcagaatcttaaagattttcgtttacagaagggtttcattatgtaggcaaatgcaggttttttgttttgttttttttttgagatagagtttcattcttgtcacccaggctagagtgcaatggcaccatctcggctcactgcaacctccacctccctggttcaagtgattctcctgcctcagcctcccatgtagctgggactacaggcacgtgccaccatgcctggctaatttttgtatttttagtagagacggggtttcaccatgttggcccggctggtcttgaactcctgacctcagatgatccacccgcctcggcctcccgaagtgctgggattacaggtgtgagccaccgtgcctggcctgcaggttttttaaattaaatttttttattttgagataatcatatattcacatgaagttttataagaaatgatacacagagatcacttgtacccatgacccaggttcccccattggtaacaagttgcaaaactatgatataggatcacaggctaggtgtgacactgataccggcaggaatatgtgcatcaccacagggaccactcaggttgcccctttacagtcatatttacttgcttcttatccccagccctccatcgcaccaaatgcagggattttaaggctgtatctttgaaaacaattaagagataaattcacggtgaaaaaattttattttccatacaggccaacagatgttctccagacagtcaagttattagatctttcctctaatcaattaattgatgaaaatcagctgtatctgatagcccacctgcccaggtaatttgcccctaaatgcctgatacaatagtgttcagtcaattcttagtgaagcagttttcatatgctatgtatgctttctcaatagaaacgtggtaacaatgatggaatttctaaattgagtaattccctttgggaaattttcatttgaattcatttagaaaatttacttgtgaaccctgtataatgtggactatgtctgtaccagataatttgaagaatgaataatttgaccctggtgataatgcggaaagtcttcattcattaaactccgggcagtagaccgtgtctctttcctctgagacgcatttagcacctgacatagcagtaggtactcaagaaccattaggtgactatggagtcattagaatacaggataaagagttcactttgcatgtcctaagttggactttatggtttctaagtattttacatgggattaaaaacccagggtgtaggaaaaaaatttacaaaccgagtctggttgataccccatagcattttacattgttctgtgtaatcaaattgtacattttgaatttcaggttagaacaattaatcctctctgacactggaatttcttctctacattttccggatgctggaattggtatataagattagtaaagttccccactgcccccccacactatacttcagctactttcacttctactgtgtaacttcattcctctttttatagggtgcaaaacgtccatgttcccatccttgaagtacctggtagtaaacgacaatcagatatcacaagtaagagctgctcggagtatgcccagcacactgttgcctctttccactctcatggcagagtttggaggttccttctaccaaaaaagtaaaaagaaatttaaatcgaaagagaaatacctcctcagagtgaaactcctcataagaagccaaaaatattaagaaagaaattagttcacttcacacttaagtggacttcacacttaaatggcacattaatagagtaaaaggggccgggtgtggtggctcaagcctgtaatcccagcactttgggaggtcgaggcgggcggatcacctgaggtcgggagttcgagaccagcctgaccaacatggtgaaaccccatctctactaaaaaaaaaaaaaaatcgcaaaattaaccgggcgtggtggcgcatgcctgtaatcccagctactcgggaggctgaggcaggagaatcgcctgaactcaggaggcggaggttgtgatgagccgagatcgcgccgttgctctccagcctgggaaacgagcgaaactccatctcaaaaaacaaaacaaaacaaaacaaaaaacaacagtaaaagtatgtggtctttctagaggggattgcttagtgcatgatgaaattccctgcctcagattagaactagggacatgctttcctgttgctggttcaaacttctgcaaaagtggcatgaacgtaccgcttttcatttatttccttttgctgtgtttcagtggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgaggtgagcactggcgtcatgactagatattttttagactagaaaataaatgattttaggccaggcgccgtggctcacacctgtaatcccagcactttgggaggctggggcaggctgatcgctgcagtccaggagtttgagaccagcctgggcaatcttgtgaaaccccatctctacaaaaaatacaaaaattagctgcatggtggcacgcgcctgtaagtgcttgtagtcccagctactcaggaggctgaagtgggagaatcacctgagcccgggaggccaaggctgcagtgagccatgaacatgccactgcactccagcctgggcaatggagtgagaccctgtcttaatttaaaaaaaaaaaaaaaagtaaaaaaattatttttgaatattgtaaagggggtgagatgtagctttccttggaatggtaaagattagccttgtgcagtttcataatagtggttcttttccagctcctcaggagagagtcctccacttagatcagtgcagtatcatttgaggcacaccaggcaccgtctccatgttttcagggaatgtaggcagaaagaacacagaccacagagctgctttctcctccccttctcagccactcttccccataaaagtgggaagtccatgccttgtccttgccagcacttttgtgcattcactgggagtcagtcagctccaccagagcaggcgcctccaggcagacctgggggaggcgacccagggtacctggtgtagtcctgaaactggcctatgcgcaagtactcgcatgaattaaaagtgtaggccaggcacggtggctgacacctgtaatcccagcactttgggaggccgaggttggcagatcatgaggtcaggagatcgagaccatcctggctaacacggcgaaaccccgtctctactaaaaatacaaaaaaattagccaggcattgtggcatgcacctgtaatcccagctattccagaggctgaggcaggagaatcacttgaatctgggaggtggaggttgcagtgagctgagatcatgccactgcactctagcctgggcgacacagcgagactccatctcaaattaaaaaaaaaaagagtgtaaaactgaaattcttttttcttttctaataaacccctgagttctgtcaatgttaaaaagaagggtgaaaactagatcttgtccctctcaatttgattattttctgcatgtgctatggaggaaggacaaggtgcaaaacgcaaaggacatgttagaaaaaagctttgtaataggcttgtttttatgtcacatgaacatagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgagtacgtgcgtatacactggtggccttcaggtggtggatttccagctggaacaaagttttttcttgggtatcaaaagaggttctcagtgttgcttttgcccttcttcctttcctgggcttcttgtattcatctgaatggactataggcactttcctggggcgagggcggcagggcaagagcagtatctttcagcaggaggaacctgggagactgtttatgttcttgaaatggagaggtttgcatttggggaagggaaagcaattcttttatttttaagagatggagttggccgggcgcggtggctcaggcctgtaatcccagcattttgggaggctgaggcgggtggatcacgaggtcaggagatcgagaccatcctagctaacacggtgaaaccccgtccctactaaaaatacaaaaaaaaaaatgagccgggcgtggtggcgggcacctgtagtcccagctactcaggaggctgaggcaggagaatggtgtgaacccggggggcggagcttgcagtgagccgagatcacaccactgtactccagcctgggcgacagaacgagactccgtctcaaaacaaaaaaagagagatggagtcttgctctgtcgcccaggcccaggctggagtgatctcagctcactgtaacccctgcctcccgggttcaatttattctcctgccttagcctcctgagtagctgggattagaggcgcccgccaccacgcccgactaatttttgtatttttagtagagacggggtttcaccatattggccaggctggtcttgaactcctgacctcaagtgatccacccgcctcggcctgtcaaagtgctgagattataggtgtgagccaccgtgcgtagcaggaaagcatttctttttctttttttttcttttgagacagagtcttgctctgtcacccaggctggagtgcagtggcacaatctcagctcattgcaacctccacctcctgggttcaagtgattctcctccctcagcttccagagtagctgggactacaggcgcacaccaccatgcctggctaatttttgtatatttattttttgagacggagcctcgctctgtcgcccaggctggagtgcagtgccgcgatctccgctcactgcaagctccgcctcccgggttcacgccattctcctgcctcagcctcccgagtggctgggactacaggcgcccaccaccacacccggctaattttttgtatttttagtagggacggggtttcaccgtgttagccaggatggtctcgatctcctgaccttgtgatccacccaccttggcctcccagagtgctgggattacaggcgtgagccaccgcgcccagccagggaaagcacttcttaaatgtaggttcttctcttgcatatgtccaccaggtttcaggtggcgcaccatgctccactgtaggaagggtaggaagcactccagtttatgtctgaggcatccgtatatatatatatttttttgagatggtgtttcgctcttgttgcccagactggagtccaatggcgcgatctcggctcactgcaacctctacctcctgggttcaagtgattctcctgcttcagcctcctgagaagctgggattacaggcgtctgccaccatgcccggctaattttttgtatttttagtagagatggggtttcaccaggttggccaggctggtctcaaactcctgaactcaggtgattcgcccgcctcagcctcccaaagtgctgggattacaggcgagagccaccgcgcccagccggcatctgtatttttttaaagccccccaggtaattctagtgaataggaaagttcgtatgagtgtagttctgcagtaagctctcgtcccgagggctcgctaccaaggctggcacttggcatgcacggtggttccttaaatcctccagcctggttcttcaggctttgaagctaagaattcatgagtctttgtccctgatgtactttccattttgttttgatgacattattactccacatttcgcttttatgttatttccttttttatatttcttaatgcaagaagctcgctgcataaacgcttcaggcttgaacagtatgtttaaggaagaaaagcagcctagaggaatcactttcaaatgactccattagccagcccaatctcctggccacgctcggtgaattctaaatcactcgggggtgggcaagggaagatgtgaagcagccgggcaggtattgttgagtatttcactgctaagaatgttagaagacaaaagcacagatagatggggggatttagagaaatgttgtcactgtttggcctagagcaggaaaaaagtactgctttcctcctctcctgtggaggctgtggtccaggcctaggaactggtttgcagtatggtactgagcacccagcctggcactgcacggtctggtggaaacgtgagaagtgtcctgtggatcgtgtctcaggtggcaccaggtttctgtcagcgcagaaagagaactgttaccaaaggtgacactcggggaaaacatttgaagtatttgaaggcagtcttctcttgctagttttgagtcaggacacctaaggaacaatgatgtaatacacatgtaaacatgttgcttttcatttgttgtcttttgttgagtttcactggtcattaacaatgagctagataagctacagagtctgcagctctgggtagatagaagattctgcccttggaagtggtcgttgtccatcactcctaaaaatcacactgaataaaggcagctccatgtgtcctgggaaaggcacaggctctctggacgcttacctatcctttgtttgtttgtttgttttgtttttacttatagtggcctttggtttatcattcatctcttttgctttcttaaacagaatatggtgcacctgaagattgggaactcaaaacacagcaaccacttatgctgaaaaaccagctactaagtaagaatctcagattcaaatagtttatttgtatttgagtgcttaggtgctgaaacagttagtgtgtttctcttaagtgtgtacctcttaagtacctaagtaaatgccttgagttttaaatgaaaatttttttttttttttttgagacagagtctccctctgtctcccaggctggagtgcagtggtgtgatctcagctcattgcaacctccgcctcccaggttctaagcgattctcctgcctcagcctctggagtagctgggactacaggcatacacaaccatgcccggctaattttttttaatcgagacggagttttgctcttgttgcccagactggagtgcagtggcacgatcttggctcaccgcaacctccgcctcccgggttcaagcgattttcgtgccttagcctcccgagtagctgggattacaggcatgcgccaccacacccagttaattttgtatttttagtagagatggggtttcaccatgttggccaggctggtctcaaactcctgacctcaggagatccacccgcctcggcctcccaaagtgctaggattagcggcatgagctaccgcgccctgtcaaagaaatgaattctttaaaacatgtttaaattcttatacatttttgtaactcctatgttttaaactcatttaatagtgttataaatgtgggaggtattggagttgtgaaccaaattgtgatttgtgaatttatgacttgaaaacctagccaagctgtaaggaaagaagtactaagtggggaaaagggaaagtattgtccagctatttctgttgttgttagcaatccatggaaggattaatagaaagaattttaaacattgattagacctgccaatttgcactgaatacctctatcatttggccatctgttgatgtgtgtggataatttaaatccatataatagtagatatcaattagtctttttctttgtttctcttaaagcactgaagataaaataccctcatcaacttgatcagaaagtcctggagaaacaactgccgggtaagaagaaccagcctgtcttttccttaaactctgaatcatcggcctaggtatgagtcagctaaaattaaaacctttaactcatgtctcaaagtgtggacctcagaacttacaggttttcattagtcttttatattctaaaatacaatcaatcatgctaatatcactcccccatgcccccaaaagttcaggtctcccctaactttatcagctgaaagcagttctgttaaaattggaagcccctgcatataattacacacacacacacacacacatatatatatacacacacacacacaattttttttgagacagggcctcactctgtcacccaggttggaatgcagtggcaccaactcagctcacggcagcctctgcttcctgggcccaagcaattctccagcctcagcctccacgtagctgggactacacgtgcgagccaccaacgcccagctaatttttgtattttttgtagagatgggttttcgccatgttgcccaggctggtctcgaattcctgagctcaaagccatcctcctgcctcagcctcccagtgttggaattaattacaggcatgagccactgcagttggcctaagttgtatttttaaccaaaaaacctgagaccttgaatggcatagccttttggaagcattccccaagcctgctgctgtttccagggagactgtgacactgggtttggggtctgcttctcatcccttcataagagaggagctgtgtcctggtgaaccaaattcttacgggaggtttgtgactttgcttacattctacttctcctgactgattaggagtccctgcaaaaacaattcgcagatgctcttttaatggacaccctgaaatggttttctttgagaaagctaccttagaacttaaaaaaattgtggtactggaactgaattacttttatttggaaaataaatatgcttgtgtcaataaagtagatcaacataacttaccttaaactttcactcaaaagaaaaatgaaattatagtctatttttgagtatgccatgatactgtgaattctcaagattaaacttgattcatagctaaatgctaaaatataaataatttagagcagtgaggatttaaataaatgaaatacacatcagcttaatgactctagtacactgggtttctttgcccatcagtgcagtaaattcacattgatttttaaattagtttctatcagataaagcaagcttatcatggtattgcttatagaaggccttagttgtgttcaaagaagtacctttctgattgataaccatccatttaatttaccacaacgtctccatttttatttattcacaatccagtttctactcctgtaatatgtaatttggctactgctatataatgggttagaattagtgatttcccccttcattattctgttttcaaacttagacagacagtaaaggccctggtggagacagactagtcaaagagggccaggactgttttatttttgatatatttttttcagatggggtctggctgtcactcacgctggagtgcagtggtgccatctcagctcactgcaggctccatcaccttgatcccgggctcaagtgatcctcctacctcagcctcctgagtagctgggactataggcacgaaccaccacaccccgctaatttttttgatttttagtagagatgaagcctcgctatgttgctaaggctggcctcaaactcctgagctcaagcagttctcctgtcatcacctcccaaagtgctggggttataggtgtgagccaccatgcctggcaggccaggactttctgtgaatgtttttggccttcgatgtctttgcgtgtttccttttgcctttgcagatacatcaaatcaattcatgggaatgttaccactatagagtatttgctcaagaatattgtcattagacctgtttcgttaagctttccttttcagtctttctctggaaggcactgaggtagacctgccaaggcctgccgtctgggcatatgcctgaatgcagcccttggctgggggtgacagtgccgccttacccttctctacttccacactgtacacctgactggtatcccaggtcttctgagattcagttagccattttgggaacacccactgcattcatgctgtttttattaatctttgggtagctagcagagattcgactatccatagaaattatatgtaagaattactactttaaactattcagaatctgagtcctatattctataaattcagcagtaagccagcagattacaagggttcctttttttccccttttttatttgcttttctgtttctcaaatgtgcactcactcactcactcatacaaaggttcttaatactaattcttatgccacatgctgtgaatatttaaccactaacataggtaaatgtcttctaaacagaaaagtaatagccaggcatggtggctcacacctgtaatcctagcactttgggaggccaaggtgggcaaattgcttgagcccaggagttcgagaccagcctgagcaacatggtgaaaccccgtctctacaaaaataaataaatacaaaaattagctgggtgtggtggtgcatgcctgtagtcccagctgcttgggcggctgaggtgggaggatcacttgagcctgggaagttgaggctgcagtgagctgtgattgagccactgcaatctggcctgggtgacagagtgaggccctgtctaaaattaaaacaaaacaaaacaaaactgcaatatctttttttttatccattagattagcaaaattaaaataatactggctggcatgaaaaagcagtatacccttttttaaagtcatgtgggaactactataaaaagttaaaaatacacatatgctctgaccaagcattgtatcttgcagcatttgtaatggtaaagatagtaagaatctaagtacttgccagcggaggaatggtgaataagctctggtggaaccacacagcacacaaggcactgtcgtgtgtcaccgaggagagtgaagcagtctagagctgcgctgtccagtgtggctgcaataaccacatgtggctatttaaattcattaaaataaaataaattgagttcttcagtcatactcgccgctttccaggtgctcagtaccacatgtggctgccatactgggcagtgtatggctagaggacatggcatggaattggcatgaaaagctataccatcatgtcataaagaaatacaaatgtagtacgtcaatatattataaaacctatacatccttttttttttgagacggagtctcattctgtcacccaggctagagtgcagtggcatgatctcggctcactgcaaactctgccttccgggttcaagcaactctcccggcctcagcttcccaagtagctgggataacaggtgcccgccaccatgcctggctaatttttgtatttttagtagagacggggtttctccatgttggccaggctggtctcaaactcctgacctcagatgatccgcccgcctcggcctcccaaagtgttgggattacaggcgtgagccactgcgcctggcttaaaacctatacatccttatatgaacacagaaaaaaaaaggcctagaggtatacctctcaaatttttaacactggtcataggcaggtaaaaagaaataatcagctatttccatattttctgaatgttaagacagtcatgttactatattaaaaatggtaatgctatttattacatagagattgctactttcttctatagaaccggtatgagtaggcaggttttttttttttttttgagacaggttctcactttgttacccaggctggatggagtacagtggcgcgatcatggctcactgtagccttgacctcctgggctcaagtgatcctcccaagtagctgggactagaggcgtacatcgctatgcttggctaattttttattttttgtagagatggggtatcctcatgttgcccaggctggtctcaaattcctgggctctgatccctctgcctcccaaagtgctggggttacaggtgtgagcaggccaggcagatttcttattagaactgttttatgaccaaactttttgtttctggcatgtgttaggagtatgtcactccccactggtgtgcagcaggtaaccccttctctcaccagccttcaaacaatgaaagccagtccgtctcaatcttttgaaaggactagactatcacatattcacacatgaaagagcaaattgttaattaaaattataaattctattaactgtattcaatacatacaaaaaggccagtttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 890 - DNA, 81554 bp, Homo sapiens; identical to SEQ ID NO: 889

SEQ ID NO: 891 - DNA, 79375 bp, Homo sapiens
caagacctggagtacctcggagctgcgacctccagttcacaataccacctgcctcacacccgggctcatcttttcatcccacacccaccacccccctctccgttcacggtgtcccgggaggctgcgacctgcgtagatgatttagcagactgcccctgcccatgctcctgctcctgctcctcctcctcctcttccccgctctctccctctcgcctcctcttccagtccaggcgcccagactcggcgaagcgcagcgcctgccaccagcggtgcctcgggctgcccggcgcgccgcgctcccaggttctgtctcgccgcaccccggcgggcactggcgcgggcaaggacgctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttcccttcttacccccacccactccaggtactccagctctggcttggggatgtttgccagctttgaggcgcaaaggcggcgggagttgggatgcggggtgtcggagggagactgagggtcgcccgggcaccgtgcctgcaccctggattatagtacagagagcatttcttgttcaaacaattcctcaaatgtgtgaacctgagaatcaacattgtgtataactgtggtttgagcatttcatcctgcttccttgcaaaaggattagaggcagcttaaagattaaataggtatggaacgggtgctggggggggccagggaaaacttgagtagaaatcacagggaggtggtgtgctccagggaccccggaagaactgtgtgatttcaaagccagctgattaaaaaacctttgattagaaaggactgcactgttgctccagccctcagaaaataatactgtgctcagtcctgataaacaaaatgcccaggtgtggaggtaatgaggcaggctcattttttttaaaatacaaaataaatcttggaagtaagagttaagatgagaagtttggtcttaagccatctccacccaatactgcaaggtgagaggctgaccccctacctaacgaaaaggaaaggaaattgagtctaaagggaagtgattccagctcctatcacaggatcatagtggttttgcatctatatgtatatttctgcctgtgcccagttttggaagaaaggaccttgtattcaacccaacgctgcttgtccttgagttagaaggataaggcagatggtgtcagcatcccaaggtgtttcttcctaacctttcttattgtccttccttgcctcctgcaccaaatctcttggggagggagcagcccaggaggaaataatagatcgtcaaatgggttgggggagcagtgttttttccaaaataatttaggctcattttatcattcttatgttttccctcaaagctctaagcagtacatcgtcctaagctgaatttaacattgctccagaatatatatttatcatagttgtacattcagacacaatatgcataaccttaaacagccaggatgcacttgtgaatcaggggcttcccttacttaatcctgcgcaagagaggcaaagcaggcacgtgggtctgattccctgtgcggtctccttcatgaggagcatatgtgaaatacctttgaaatacagagaagattgagacagcttttctctttctggtacagttgctttcctgctgaattaaatgagatgaccctgtcttcaacaaataaatgaatggaggcatttgaggcccatttaacaaatgcacaaaatatgcctgcctctgtttttcctcccttcagagctttagcctccagcccacggagttgtgatgatgaagcccacctcctaagtgggactcagctcagtttctgtatcatatttaaaacagagtatgttgcttatttctaaaattgcatagcacctcaccactaactattttgctgcatagaggtatttcatcactaagagagctatatagagaaactcactcaaatcctgattcatcattgttgatagaacttaactattgtgtcatcatcacctgacatgggctgcagaagctccaaggattgctatagatctcaattgagacttctagtaacagagctagaaaggagccttttaaagtgtagccatgactctggtcattaggtatatgcatgttcaaatattcccttacgtgcttgttttcgctttcataacaatttccagggatgaaaacttagcagattatttttataatgaagagtattcaaattaacaatgtgtatccaccagctaacaagttttaaattccacagaaatcagcatcacaagcatagtaaaatcaagttttcattctttcctcttctgccataatgacttcattcaaggcctagtcccagaccaagtgcatggaaacgatggctcatgtctctcaacatttgcccaagggaatggtgcctaccttgcaactcagcgtgatgtcacctttattagccattctggtgtctatacaaaatatttgctccccatttcttcttatcgatgcctggtcagcaacaatcatgtaaataagtttccattcttttgaggaagataacgaagtcagcgtttttcagaagtggtgcctaggaagagacaaaatccaggacacacctctagttcaggtaacactgcaatatatttcaatttcctgctgcgtgatggggttattattgaagagggaagtaaggtatatcattcacagcacattgtccccacctggctcaagcaccacccattccccaggtgggctcaatatgctacccccaccaccaccaagataccaaggctgcaaatgaaaagtagatctcagccaggcatgatgggtcacacctgtaattccaacactttaggaggccaaggcaggaggatcacatgagcccatgagttcgagaccagcctgagcaaaataatgagaactcatctctacaaaaaaatttaaaatgagccaagtatagtggtgtgtacctgtagtcccagctacttgggaggttgaagtgagaggatcgcttgagcccagaaagccaaagttgcagtgagccaagtttgtgccacggcactacagcctaggtgacagagcaaggccttgtctcaaaaaaagaaaagaaaagaaagaaaaagaaagtaggtctctttgcagaaagcctcaggccctgaacttttgtgtcatcttctcattactcaagtctaattccctacatctcacttttacacacagatcatttttttcatgtttgttttgattgcccaccctggaattctatttctgcactaccctttaaaagtgaaagatcaaatctaacgctctaatgtgggaaagcattccctctatttctacaagcttatttacacaaaaaaataagcttgagactgatcaaaagctgaatttctaccaaataggaacttactttttatgccgtaaattatcaaggccatctcaaggcagaggtgagtttagcatctcatgctttatgctcctttcttctgcacctaccagatttttattacatgtgaaattatatgaacataaaccccagggaaacattgaagatgagtgtgccgtcacaagtgacgaggggacagatgaacagggaagagaaatggggcagcagcactttagagtgacttacttctctcttgttttctcctccctgaatcattttctagaaccagtattgtggcccctaaaatttggggcttaggtcagtcaacttaccaaagttcatcttcctggtgatgaaaggactttcatcaaaatcccagctactttttattcgttcccacattttgtggattaagaaactgagaaccagaatttatagagatcactcaatcaattggcatattcccggatcacaacaaattgataaaattcttgagaaccctctttctaatacagattgactataattttgtctttcatttttagttctcttattttgtctcatgcactgtggattatctggtttactgcagtccttacctgaatagatgtcagtgttttgatcccattgttgtattcccctaaaacacgtcaaatgaaaaactggacactttaataggtttattgttagcactctctcatgctgatcaattctcaacacatgcagttgtaggattaggaagacaaaatcctttagaagaagctatgaaacctaatccttctgcatctggatcattttaaactacaagttgtaagaggaatgagcatctctggattctagttatcagtgcagaccagatggaaggtctttatgaaatctggtatgagaaggaaagcattttatagcaagaagaaaatattttgagaaatagctaccagcagcagcagctagcagttctaaaactctcagatcctcctaatgaccccattagggagggaggaagggagcaaggaaggaaggaatgaaggaaggaaagaagaaaggaaggaaggaaggaaggaagggaaggagggaaggagggaagtgttataaatattggtcagggaaaagttttattattaatgacagattaaataattagctactaggaaaattcaaggggatacataaaaatgccattagaaagaataagagaacccagtaaggtggctagctacaatagcttgcctggttagcgacaatataatcatagggatttatattacgcttgtacactgttgggcagaaaacatgcctgagaggtataaaagatgctgttagcatccaagaaaaatgggaaaggaaagcccacctcatctgaggaagatggaggaagaagaacctacagaaaaggattccacattccaaactcatccctctgaattcagtaatatttatccttatatgatttctgacagtgtagtttgtcattgtaattaattctttcctgtaagtaaacaagaattgtatacttacttaagtaccttacattttaaactttattacatagtcctaattttaatgttgaactctgccctagtcaaggaagtatttgttacctaacacaagaatttgatatacagtcatccataaacactatcctaccatatagttcatcataatttaacattcaaagaaagaagcatgatttcctcttttattatgctttcatttgagccattttaactttcttaccattctttccttctgaacctaattcaattccttacacaatgctctaaaaaatcaaggattaaatatgtaacttaatttataattagcaaatacatcatttacaagatgcattcatattggcaagcatattttatttcatagattgtaaactggtaaaacaatgtaatctcctcaccctctctgcaatacagtaagcctgtttctaagaccatcaaggttttactttatgtccgaggcattggagaaccagactgtactgaccccagggtttggtgacttacatataaatgaagcatcttaccaagaagggatgaaaaatgactttagaggaagcaaaagtctcaaagctcacaagacttgattactttcagcttggtgacagaggcaatgctcttgtgatgcagatggagtaatttctccagcacaaaagatgtccagccgggtcccattggctttgagataatctctcacattgcattaagtgtactgagtaccctttctcagacttatgtaccattagcatgcatttaattaacagttaatgattacatagtattgttactattaccacatagtcctgttatattaaaatacatgaaatttgtagctatgttttgcctgtttagtaaaatgagtctgaatctaagggtgagagggtctacacacagccaagaggatggggtattaacccaggcctgtgtgaagatatttgcatctcatggaatgctctccagagaacaaactgacctaccctgtgcatgtcagctaagctcccgccagcttcctcagggcttgctgaatgtacagtgagtgccacagtgccagcgtggcagtgaagcacaggcccaactctacggacctggggtcagaaggcctgggttaataccccattctcttggctgtatgagctgcatggtctgtcatcgttacaatggggacaataatacatgccctgtctacctcagcctcctttcagggaagtttctcaaaacagaatatgctattgtgattcattgtcacctgtgatgtcaaactgcaccttgtgttatactactagggggtaacacagcatggggctcaagcccaagctctcgagtccagaaagccaggttcatatcccagctctgccattcattaactgctttcacatctctaaacctcagtttcctcatttgttggggctcacataacagtactatgtcatagggctatttatgaggattaaatgtgtgtattcattattgctaaataataaattaccccaaaacctaatggcttaaagcaacagatttttattatctctatgatcatagttccatgggttgggaatctgggtatggcttagctaggtcctctggctcaggtctgtcactcacaggctgcaaagtttcagccgagactgcagacatctcaaggctcaactggggaaaggtaacgcttccaagctcgctcacgtggctgttgacaagcctcaggtcccagctggctgctggctggagacgttcttttgctaccacatggacctctctatagggctactaacaaaacagagtgcttcatgcagatgttgcagcttgctgtccttggagcaagggctaagattgaaagatagcaaaatagaagccaaggtctttttgtaacctgatatcagaagtgatatcccatggcttctgctgtgttcctcattagagacaagtcactagtttcagcctaattcaaggggaagggattacacagtgggaggaatacctacaggaaccaaatcattgagagccacctgagatactgcctgccacaatataagacatcagaagctgtttgataaagactcaattcagtatcacctcgtggttttatctcatagtaatgttctcagactgaaattagataatctgtcaaagaatttgtaaaatataaagctctatacaatatcaagattttattagttttattaatgctgagaatccagttccactttatagatagtgatataagaacagcaaatcaatgattaagagatgtgaattttacaccttgctgtgtgtgtgaccttggaaaagccatttatttgtttcataccttagttctctcatgaaagtgatgataataacagacttaccaggataaaatagataatagacagccatgcagcacattgacaatattttggtcacccacaaaccacatatatgacagtggtcccacaaattataatggagctgaaaaattcctacagcctagtgacatcatcgctattgcaatgttgttgtagcacaatgtatcgctcatgtgcttgtgatgaggctggtgtaagcaaacctgtgctgccagttgtataaaagtatagcacatacaattatgtatagtatataatacttgataataaacaactgttactggtttatacatttactgtactatactttttatcattattttggggtgtgttcctacttaattaaaaaaaaaaagtgaaaagaagtttaactgtaaaacagcctcaggcaggtccttcagaaggtatcccagaaaacagcattgttattacaggagatgacagctccatgcatgttattgccccgaaggaccttccaacggacaggatgtgtaaatagatacagtgatactgataatcctgagcctgtgtaggctaaggctaatgtgtctgtatcttagttttgtttgtttgtttgtttgtttgtttgagacagagtctcagtcgcccaggctggagtgcagcagcacaatctcacctcattgcaacctccgcctcccaggttcaagcaattctcccacctcagcttcctagtagctgggattacaggcactcaccaccatgcccagctaattttttgaatttttagtagagacgggatttcaccatattggccatgctggtcttgaacccccgacctcaaatgattcgcccgcctcagcctcccaaagtgctgggattacaggcgtgagtatcttagtttttaacaaaaaagtgtgaaaaggaaagaaaaaatttaaagttttaaaaatagaaaaaagtttataaaataatgttataaataatgagaatatttttgtatagctatacaatgtgttttaagctaagtgctattacaaaaagagtcaaaaaggtttttttaatttaaaagtttgggggttttttgttttgtttttgtttttgtttttgtttttttgagatgacgtttctttcttgcctcccagactggagtgcagtggcgtggtgatcccagttcactgcaacgtccgcctccccagtttcaagcaattctcctgcctcagcctcccaagtaactgggattacaggcatgtgccaccatgcccagctaaattttgtatttttagtagagatggggattcactatgttggccaggctggtctcaatctcctgacctcaggtggtttacctgcctcggcctcccaaagtgctggtattacaggcatgagccaccacacccggcctaattaaaaagtttataaagtaaaaaagttatagtaagataaggttaacttattattggagagagaaaaaatggtttttacaaattaggtatagcttaagtgtacagtgtttttaaagtctacagtagtgtacagtaatgtactaggccttcatattcgctcaacactgactcactgactcacccagagcagcttctaatcctgcaaactccattcatgataagttccctacacaagtatcccattttttatctttataccatattttcactgtaccctttctacgtttagatacacaaatactattgtgttacatttgcctacagtattcaatacagtaacatgctgtctggctttgtagcctagaagcaataggctatgccacatagcctaggtgtgcagtaggctacaccatctaggtttgtggaagtacacatcttgatgttcacacaatgatgaaatggcctaacaatgcatttctcagaatgtatgatgcatggctatatataaaattatgctgaaatctaaaaaaatgagatgatggtcataatgacaatgatgaagatgactatatgtttcagcttctactccatggtcctttgaggacaactgaagtaactagatatgatttttgtcagttgtgttttaagtgtatgtatcaaatccagctaccccaagttttacaataactttatatggtttaatcttatcttgctgaacacattagatatgctgccctgaaaagtggcttgcaaacagaatttttagaaactgaaccataattaaaatgcacagaggccgggcacggtggctcacacctgtaatcccagtactttgggaagccaagacaggcggatcacctgaggtcaggagtttgagaccagcctgaccaacatgaagaaaccctgtctctactaaaaatacaaaattagccatgcgtggtggcacatggctgtaatcccagctactcaggaagctgaggcaggagaatcgcttgaacccaggaggcggaggttgtggtgagccgagatcgcgccattgcactccagcctgggcaacaagagcgaaactctgtctcaaaaaaaaaatgcacagagaaggtttccatgtatctagtggaattgtacaatgcttatgtgatcttgtgatatcattaatattttgtaatataaataattatcctcattattttaattttctggcattgtagcaacacctgtataaatatttatagttacttaagaactcacaaaacaaccttttgaagtaggcaaataaaaccaactcttggttatctcaaagagttctttttgtttgattcttgtgttatctacatttcttctctcactgtaaattggcataaatttggcagatacaaaacaagtaaagttcaaactcctccactcaaccactttaagggattttttttcctgcttataagtatatcacatgttcattgtagaaaatttggaaatgcagaaaagtataaaaaatgtagttaaagttactcttattgccaccaccaagaggcagccactattgatactttgatgaatttctgccttagtgctttccctctctatagggagaaaagagtggtttctttttcaatgaaatcaggagtatgttatatacttttcttgtgttctgctttctctaattaacattattttttaaatgatatttccatttattgattcaacaacataaattagtaaatattgactatatccaaagtggaatttggatgaactgtaagaaatatagttaataattgaattcagattttttaaatcaattccaacaattgtgaagtagtttcttttcctttttttaaaaaattttactttaagtttggtgatacatacgcagaatgtgcaggtttgttacataggtgtacatgtgccacggtggttcactgcacctatcaacctgtcatctaggttttaagccctgcatgcgttaggtatttgtcctaatgctcaccctccctttaccctccaccccgcgacaggccccagtgtgtgatgttcccctccttgtgttcatgtgttctcattgttcaactcccacttatgagtgagaacacgtggtgtttggttttctgttcctgtgttagtttgccgagaatgatggcttccagcttcatccatgtccctgcaaaggacatgaactcattcttttttatggctgcaaacattatctatttaataagtttcacatgtaattattatttgaaaacatcatttctaataagtatataatattgttgtatggatatactatatcttatttaaccagtcattactattggacttttaggtggttgtcagtttttatactgtaaaattatagcatgaaaagaaaatttttacataagtctttgtcattcattattctagttatcttagtaaaagtagcaaaggagtccttgaagtcactagggggaaatgaggtttggtaatccaagtataaatatatacaccacagtcttctcttccctcttccctaccacttcctctcacctcccactggcagaaatttgcaggcttttaatgctggaaattgctgaagtaacaatctaattggggtggccatctgtcgtttttggcccatatcgttcaggtcacactgaatgcacccttggctccaagagtgacatgggacccaggcccatccaaacatcttgttctccagggcactgtgattggttcagggataggccgtgatccaagcagaccaattggaatcaatgaggctcagttgagaggtgttcaggtgccatcacctacattggatttggagatttaaggatacatgccaggaactgcagggacccaacataaggggagtgcctcctgaggataaaactttacatggaggaaggaagagcccagagatggagaaagattcttgggtatattatttaagtttctggatccacctgtgcctgatctacacttgacactgaagtttcatgagcaagtaaagtctccttctcacttatgccaatttaagaagatttctgtcatttgtcttttaaaaggtctttaataatccagagatttttaccctctcaattgatgaaaatgagttgtagttaagacagattctggaactgaatcctagttccatcactgacagtgtaacgagggaaggttatatgacctttccccagtcagcttccctacctataaaatgaaaataatgctaatacttatcacctcagagaggtttttgcagggttaagtaagttaatatgtgaaaaagtgcttaaaacagtatctggtatattttaattactacgtaagtgtgtccctgctgctgctgctgctgttgttattttgaaggcagaaagaaaatgcaggagagtaaatgacctatttcactcatgcagagatttagcagccaagctaaaattcaaatttaggtcttctcttttctctgcttgttgttctttctcaagagctaagcctatcgtcatctttatgatatatttgagtattaagctttcagaagtttccatccacataattgaacatttctatcaaaagttttgaggtagaccaggaggccagaaaatagatttaagttactagcaataaccagatgctactgtaggattataggttatcacaacttgtaactaaaaattatgatttttattataataagtttaattacatttatttaattttaattaaaattaaaatacattttattattataatttctactttaacaagtaactatacctttcactgtgttttatttagcacctttcacagtgttgttgtcttttttaatataccttcctattaaaccagttgctctttgcagaatgcttgaatcatttggctcttggttagtaggctcccgttacctaaccaagcactgagtgaacgtatttactggggaggcagctggtctctcccaaatgtaaatcagatttcatcatgtctggcttggagagaacgtggcatatggcaaatgaagacacagctgcatagtgaaattttccatcacaagttagtctaatacctgaatgcagagtgaataaaacattttctaaacaagaatattatgttcaaattcataatcattgttaaatattaagagtcaggttatttcccttgaattatacaaaatttcactattcttgaaaaagtacatgttatcttatatttaatgtcatactattcacatccaggctgcctttcaacttctattatttaaaaatattttcagatatctacattgcctgttattaaaatgcaaactgttctttgagtagagaacctttgtgtaaggccttacaaagttctgatagagatgaagtgcacggaaggaatgacagtgtggtgggaaggtccatggccttaggggaatgggtgggagcctaagctttggagcagttaggttggaattcagacaaagccctgccacttctaggctgcaaaggtattgaacaaggtacttaactaccctctgcctcagtttccttatctgtgataagaataatatcatgtaatgataatacaaacatcataggattgtcagaatcaaaatgagaaaatgtatgcaatattcttagcatagtacctgccacataataagcactcaaaaataataagacctgcttcatcactggctctaaagttgtgtccaattggtttcataaccctaagaaggctatcaaatcttcctgggcctcagttttgtcattagatgagtaaattggaccaaattctataaaaagtgcctttgggggttaaaatgctatgacaatgcccatacacattggggtaaaccaaaaatctataacaggggcaaacttgggaagattttttcaaatctgtttttctacactgaaattgagctgcatcccttctccaaaggtgatcatcttctctaataataaagcaaggtttgtctatttttaactttttattgatccagtgctcagatttttcagcaccatttggggaggagtgttcaatgcctcattgcagaaccttccttgtcatgatgattttgataatattattgacattctttcagattccatagtgagtctttgtcatgatcaaagggctcatgatgctgataacacaaacaagagtaaccagttcaagaattaatttggttaatgaggatcactaatacggataatttcttcctaactgttttggcgggatgcattatttggttgagtgtattatcttgtctacactgatcaagctagcttgaaactcttcttatcagcctttaactacgtactttaccaacacagcctttgaaatatttgttttcttttcatgaagagcttttaaattttttgcctagattccaaagtaagaaatcaatttaaatggcataactttcaaactagacttctgaaagactttatgcatcatcagtaaatctaaattgatatttttctttaaaagatgcaacttttctatttcctatgtaaataactgtgactctattgatttataaactccaagaacaattaccactagggaaaaagacaggataaaggagcatttgttgtcaagcagatataatattttgaactgatgataatgtttcccttacaaaacatgcttgtattaactgatatttatactcatttttgaaaactgaattacagatttatgaaggatatattcgaaacttaattcactaaaagaaaaaaatatatatgtctattgaaatatcccctaagaagcagaaaaatatttttgttctagtagtataaatgaataatgcaaataagaatgtcacctgaattttaagtaacacacagtatatttggaccccagattgacaattggcaacagtaccagaaaataaactagaagctagatgcagccaggccttggcaaatatatttttatactgttgttaagaaactcataataactgcttcctcactgatgtgaactttccttagttgacactctcttgattacaagtacacgatgcctactttaaattatccttaatcatgaagggaatttgttagaagatgccaggatatttggtgaaactcaagagctagagttagctactaggaaattatcaggaatctagaaccttatttttctcttcccttttttctctccaagactggctttgaatatttctacacacatgtggctaaatgtgggtgtcccatagctccttagtttcaatttcgagattcaaacaactcacagagaaaaccaacaagcatctctcactcacagttcaaattcctagaaaaaaagggagtttggcccagctatagttagctgtctatccctagcccatcaacaatggtgcaaacataggtgctgggaatctagtcttagcaggaggggaacagtatgcagaaaaagggggatctgtgttgtacagacaccccaaaaaagttgtcttttcttccttttggcttacacatacacacacacagacacacacacacacacacacacacccctaccattcttcccatttattaaaaggtctccctgccatatatgacttaaccatcttacactgaactacactctcattcacccccttcctaaaggggataatccaatcaatcatatctagcaactgaatcctaaaatgtcatcaatgggcccctcttctcaaagtgaatgatccccagaatagtccatcttttctgtagattaggcttcattttgttcagaaaaatagctttctctttttattctgcaacataatgattgaatggtaaaattagaaagttatcagtaaaaccacaaacattcccactcaaaaaatgattacaagaagcaaaaatcttcacagcaacatcatacattggttaccagaccagagaatatattgcatcctgcaagacaaggattgcaagaaaggtgaagagtaggataaataggttttatgggcttccattattgttgggatgggttccttcctaaatcaagtacttcactacaatataatgcaaataaagtgaacctctctgcatgctgccttgactgactcagccaaccagtttcatattctttacatagctttgttaactgtagctctctctattgatgcaatttctctcttagtcgagatccttttggttgtgagtaaaaacatacacagatacaaaaccacagactttaagttagcttaaggaaaaaatatgttgggaggagtttactggaagggttccaggatacattaattcataacaaatgaccccaaaacttaatggcataaaatggcactctttatttaagtcagttttggagattatctgggtagttttctctttatttaagtcaattttggagattgtctgggtagttttctctgctgagatttttcctgcctctgcatgagctggcaggtcagttacaagccagatgatctactgtgttctcacatttctaagggtcggcaggctgtcagctagtgcaaaggaatcagtggttagaagggactaggccatgtggctctcaacatccgggatgctacactaggcatcttcacagggttcctaaaagtacagtgaagaaagcagcaaagtccttgagactcaaactcaaaactcacatgattccatttctgtcacattctattagtcaaaataattcataaggtcagcccagactcaaggaacagaaaacagattgtattagtctgttctcacattgctataaagaactacctgagactgggtaatatataaagaaaagatgcttgattgactcacagttccatagtctgtacagaaagattggctggggagtcctcaggaaacttgcaattatagcagaagcaaaggggaaacaggcacatcttacatggctggagaaaaagcaagaaagtgaagggggaggtgctgcacacttaaacaaccagatctcgtgagaactcactcactaccatgagaacagcagagggaaatccacccccatgattcaattacctccaacaaagcccctcctccaacattgggaattacaattcaatatgagatttgggtggggacacaaatacaaaccatatcatagattcacctcttgatggcaggagctgtagtagggacatttttgcagtctacaacaagggatattatgaagaagtcaaagataatttgtatagccagacaccacaaggggctagaactgtgaactgtaaagctggcagagcctgagatatttccatttttattcaggctgtctgtctgcctctcatcatatggcctcttactctgcttctctcactaagacatcttactttattcaattactttattcaacttactttattcaaggtatgtatataagaccctagaggcctgccccacaaatccccagtgtgcatgtcttcagttcaagtgatctgctcagacagctgaatagtatctcttagcaccaatttcaattcccaaaacagaggatttgattgtcccagatttggggcagtgattcatcccaattcatccactatttctggatggggagccacagaatagatacgtggttactgtgaggcccctctgcagaagagagcggtgtgggacccttctcagaggatgagagactcaggagatgctttctatcacagaatgtaatggcaaagcccgtatgccctgaaaaattcaactctccaaatgaagtcagtattctgttaccaagtcagtgccaggaaaatgcaagaaaaattgaaaacaagcttgtcattttcttctatttttttctgagtctgaagtgcccgtagatactcttaattcttctagaaagcttgaaagcaatatttaatggaagtcaaatttggtctgcagcagatttctttctcatttgattttctccttcttatcttggaaacaacctctaatgagagaaatattccagagcaccatctcaagatgtatctgggaaaagaacccattgtaccccagagcaaatcgaccctctgctccctgacaatatgcttggttttcaacagcttccctgatcccagttcttatgactttaccacacttttctacacttcccagaggttcagcaaggcttccgtctccctgccggtcttgtcagggcaatctcttcactggcaccatggcttattttctacagaaccattgaaagcagacatggttcccatgcagattatcttcccatttgcacttaccaatcatgtgaactcaggcaggtccacctccctgtcagcttgtctcctgcaaaatttagacttcatgtattttctgtcactgctattctgtatgtttgttatcagatcaaatgagacgcctgcatgcggtagcaccttaaaaacgttagaatgctctgtacatgtagagaaatggaacttctctcacagatacttgatagtgagataaagtggcacgggtcatttcatgtccagtgtcatcatacagatgtaaaatcccaccttggaaatgtaggtgaccacatgtagaattttacctctgcctgctcatgagaccctgtgcaaaggactcagctaagtcatgctcaggcttctgatccacagaagctgtgagataataaatttatgttgtttaaagctgctaaatttgtggtaatttgttacacagcaatagacaactaatacagtgttcaatctcaaatgtaaaataacattttacataacagaatgctatgtgtaggcttgagtgagtgagagagagtgtgtgtgtgtgtatgtatgtgtgttccaaaggaaacgtattttaaaatgaaatacattttaacatatggttttcaaaaagctgagaaactgatgataaatttacacttgttgctgcaacatctcaatattgtaaaccaaaaataaaattctaagacccccccaaccaattgactgaaaccccctctcagtcaagggcattccaaagtaaacctgaaaaactagttcaggccatgatgggaatgggggattagacacacctcattatacccttctctctttggaattggggcacaatggaccagcattaacactacaacagagatctcaagactgaccaaagagattctttgtggcaataaggtatatcacaaaatcatagatagcaggccctaaaagaaatagaaagtattttaccctgaaatatatttctttgatgtattttaaaatggccctgcaaagctgtctcttgtgggagaaatctacattctataaagaatcctcttccctttccaggtctttttctgatcccagaaagactaactaaaagtctggaacctttaaaagtctgataagaaatatttaccatctaatctctctgaagcctgctacttggaggattcatctgcataataagaaccctggtctccacaaccccttatcttcattcagacattcctttctatattgattccagttctttagataataacttaacactttcaaccaattgccaatcagaaaatctttaaatccacctataactggaagctgccctgccaccatcactgctttgagttgttctgcctttctggaccaaaccaatgtacaccttatatgtatcaattgatgtctgcttgtaacttctgaccccctaaaatgtataagaccaagctgtaacccaaccatctgcgtacatgttctccgaccctcctgaagctgtgtcattggcatgcccttattcttgacaaaataaacttctaaattgattgagaaaaaaaatttaaaaaaataaaaacctgattttcttggtcagagctgggctactacttgcttgccatatgatcttgcacacattatttatggagttttttatgtttcactttctgttttttaaataagaacaactccactaacttcagagtcttatgagaataaaatgataaaaggtatgtgaatatgcttagcatactatttggccatgctagaagactataaggttaggttttgtttatttgtttgtttgctcctttcttggtgttcactgggttcaatggctaagttctattacatgttaaccttgtcgtttagtatagaaaacaatgtgagatttagcatgattattgaaacagcaaatcttcagaaatccaacaaacctatggcactcaaacagcttagtaaaacctacccaacaaaatttaagaagtcttggaagcagatggtttggggcatctaggctccagcccaggggcatttttgctggcatttgtgagacttttcaaaaacaataagcagtcaacattgttcaaggctcattttttccctgccttctgaggtgactacttgagcaacatctttcagataattctaatctaagaagaattttttattttaaccttttaaaaaggcaataaaataagacatctattttttctccaaatagctttgtacgataacctctatttattaggacatttgaaagtttcttaccatatattctagccaaggccatcttttttttatgaaacattgttagaattaaatcccagaatttcagatgagctttcccttacactgtcatatttcaccttacctcttaacttttaagggactgtccatgaatacctgagccccaacatctcagtcacttggcactggagaaaaatcatagtgccacccacctatcttctgaatcaatgtatctgaatgtttaatattttccatttgttttacaatttcttacaaaataaattattttcccattgaggaaaagaaagatttttatgcatttgcatgaaaaggtttcaaagatattgttaaatggaaaaaaagggcacagtaaagtaaaaaatagcttgcatatcgagatctcatgtgcatggaaatgcatgggcaaaagcctacaggagcacagtggtggatgctggtaacctatggaaggtgagtggagtgtgagcagagagggggcctgtcacctttagtcatatatacttccataatagtaaaattttttaaactcaggctatatccccacactatttaatttttaaaattgtttttaactgggcgtgggcaggaggcatgcattccttgaccaatagaggcatttttttttttttttttttgagacagagtctcgctctgtcgcccaggctggagtgcaatggtgcgatctcggctcactgccagctccgcctcctgggttgacaccattctcctgcctcagcctcccaagtaactgggactacaggtgcccgccaccatgcccagctaattttttgtatttttagtagagacgaggtttcactgtgttagccaggatggtctcgatatcctgacctcgtgatctgcccaccttggcctcaatagaggcatttttaatttacgagcccatgggagaagcccatgtgcctatactcaaatgccagctcctcacaatgaccccaaacattctgtctaaagtgccctctcatcttccagtctgttcctgtttctgttttttccctcatgatacttgctacgatccaaaattaataagtatctgttggcctctgttttctcccagctagaatacaggcattatgagggcaggagtctcatcaatcttgttcagttttcatctccagtgtctagaggagaatcgagcattgagtagatgctcaacaaatatttgaataaatataagaatgaatgagacaaatgcccttgtgccattattgtctgctataaaactctgaaggagcaggggctgcaagcaaaaatggcagtgggcccaagttttacatctgcttccaaagtactatttcttatttgttagagaagacatttgtttcaagagatctaagagaaaatttgcctggtggaagatcctagcagccccagactctgaacaggaagtgtctaccaaccagatattggcccagctcccacacagcataagacaatgtattaatcagggctctccagagaaacagaaccaattgcacgtgtgtgtgtgtgtgtgtgtgtgtgtgtgtgtgtgtgtgtgtgtgtacagaaagagagagattgatgttaagaaattggctcacacagttgtggagcctggcaagttcaaaatctgcagggtaggcaggtaggctggagacccagggcagagctgatattgcaactcaagtctgaagacggtctagaggcagaattccctcttccttggggaaactcagtcttttttctcttgaggccttcaactgattggatgaggcctaccacattgtggaggataatctgctttacctgaagtccactttgaatttaagtgttaatctcatcttaaaaaaagaaaaaaagaagaagaaaaaacactcagctgagcactgtgactcacacctgtaactgcagcactctgggaggccaaggcaggtggatcacctgagctcagagttcgagaccagcctgggcaacatgatgaaaccctgtctctacaaaaaaaaatgcaaacgttagccaggcgccatggcacctgtatgtaatccccagctattcaggaggcagaggcatgagaaatgcttgaacccagatggtcaaggctacagtgagtggagatcctgccactgcactccagcgactagtgttttgactaatctgggtaccattgcctagccaggttgaaacacaaaattcatcatcatgggcaggatgacggaacctcagctggagccttagctgtgtaggtaacacagagagtatcctgtggtgaaaaaattagaaacagacattgtgtgagaaagaaggggcaagttttgtgtaacatcctgacaaattttgaatctctgttaatcctcttttatgcaagtatcagaagatcacttcatgttcagccataggagccctttcctcatagccccatatcagccaagcgcatatagataaagctgcaggcaaagataaggcgtctctgaatccccagctgtgtctgtagggacactcttccttagtgccactatattcctcatactagtaaggaagtcagccaattctactcaatgtacaagtaagtacattgaaatgcagactatctaaataagcaaactgaagaggcacactgggaaagttatccagataattcaggataaaattcagcaggtgtcttggtctgttttgtgctgctttaacagaatagtgaagactggatgatttataaagaatagaaatgtatgtcccacagttctagaagctgggtaaccaagatcaaggtgccagcatgtagtgactagtgagggccttcttgctgcaccatcccaaggcaaaaagtggaaggacagaagggggatgaatgctgtgtcctcacttggcggaagtgcagaaaagagcaaacccactcccataaccctttttatactgacattaatccattcataaaggcagacccctcctgacctaaacacctctccaaggccctaccacccaacactgttgcattggggattaaatttccaacatatgaattttggggacacattcaaaccaggcaagtttgaaaagcttatatttggggtttacattattccacctggtgaacttcaccagttagactccatttatgacacagctcaggtgaatgttctgttatcccggttgttcaatcaagatccattgagctgtagtgggtgggggaagtgaatcaggagcaaacacttcaggaaagtgaggttaaatgaaagaaaggctgagctaggcacggagaacctgaattctagattttaacacctctcttgatcatttgggacaagtcacgtaaccctaagcctcagtttcctctctgattctcctttagccctatagtttcatgggatgtctaatctcagacactctgctggccatgtggcctcagatccctctcctaatgcctaatatgtgttagcacccttgtgctttcaaatatctgctactactgctagttttatttctaccacttaaagaatggaaaacccatatttaaaaaaaattgatttcccccacaatagtgtgtctgaatacagattctgaattgctttacacatatactgtatgtttatctaattataagtagaaaataatattgtgccagtgataaaaatgaagctaggaactatcaagagagcctggtcctatttccaaataccattatatgctttagtattttggtttcaaatcagcttccaatatttggggagtcagtttttcttttttgatattttttctgctcaactgtttcagaaaatctcttgttgctatggaagtcaaatgggatttttcatctgttttaaaatcatctcctcatgcctttacaattaaaagtcatagctaattataatgcttacctactgaatgtggatcccatattaaacaaaagaaaatatatgttcataatgtcaggttcgtaagaaaaagaatttttttaatttaattattttaccagactttaagtctttcccattcttacacatcccatttgaatgacactaaaatgtataaaatcaattatatgagtttaatttgcccaagcttggtataaaattttattattcccttcctgagtatccggctattctaattaattttctcctccttatcagcggatttaatgattcacttccatgcccctcttttgccaagtgcgtcagcgtgtattgttagccagaggtgtctccatggctgttaagaagctctgactcggtgaagaaacagaagcagtgtgctgagcaggagaagagggatgaggtcatgcctttgagcaccgactataacctttatgttgctcttggtttttgtaatgcacacatatgcacatgcaaatatacatgtgcacacaaaaatgcatgcctagctatatgaattctcatgtcagaaatgagtggcgagtgaagatcagaacagatttcacatttttaacctagtctaaattcagctcctttgcagaacttcatctgagtaatcccttttaaatctgagccctccagttactccagattttcttagcacttagttagttacgtgcatgcctctgctgtcatagcaaagtcacaggctgacatccacagcagggaagataagtaacaaatgcatgaacttgtggcacaagatcaagcactgggtgtacagctcatgactggcattgaggaacatggtaaaaaaggaagggaaataaagcaagtaagatttttgtttgaacattaaggagaattttttggttaggtacagtggaacagtttataaaatgtggtagtatgatccccaatcctggagcacataaagaagaaaataaaaaaacattttcctggagttgcttgggtcagaaatgtcagagatgcagtgcaaatcatcttatcagctatttgagaatggtcagatgtagacatgaagagattaacataattattcattctataaatacagtcatacaccacataataatgttttggtcaacaacagaccacatatacaatggtggtcccataagatggagctggaaaattcctattacctagtgccatcctaacatcatggcacaatgcattactcatgtgtttgtggtgatttggtgtaaacctactgggctgccagtcatatgaaagcatatcacaggctgggtgctgtggctcacacctgtagtcccaacactttgggaggctgaggtgggcagatcacttgaggccaggagtctgagaccaacctgcccaacatggtgaaatcctgtccctactaaaaatacaaaagttagccgggtgtagtggtgcatgcctatagtcccagcttctcaggaggctgaggtgggagaatcacttgaacctggaaggcagagattgcagtgaaccaagattgtgccactgcactccagcctgggtgacagagcgagaccctgtctccaaaaataagataaaaaataaaataaaaataaaagcataccacatacaattatgtatagtacataatacgtgatctctgttactggtttatgtatttactacactatacttttattgttattttagtgtgctccttctactcattaaaaaaatgttaactgacaaacagcgttaggcaggtccttcgagaggtattccagaagaaggcattactattataggagatgacagcaccatgcatgttactgccccaaagaccttcctgtgggacaagatgtggaggtagaagacagtgatattgatcattctgaccttgtgtagtccaaggctaatgtgtatatttttgtcttaatttttaacagaaaaatttaaaaaataaacaaaaaaatttacataggaaaaagcttataaaataaggatataaaaaaagaaaatatttttgtacagctgtacaatgtacaccactgcacctggctaacttttgtatttttagtagggacaggatttcaccatgttggtgtttttttatcaagaagttaaaaaaatttaaatacttataaagtaaaaatgttacaatgagctaagtttaatttataattgaagaaaagaaaatattgtttataaatttaatgtagccttagtgtacagtgtttagaaagtctacagtagtgtacagtaatgttctaggccttcatactcatccaccactcactcgctgactcacccagagtaactttcagtcccacaagctccattcatggtaaatgccctatacagatgtaccatttttttatcttgcatactgtatttttactgtacttttttatgtttaaatacacaaatatcattgtgttacaattgcctacattatttggtacagtaacatgctatacaggtttgtagcgtaggagcaataggctatatcacatggtctaggtatgtagtaggctataccatctagatctgtaagtacactgtgatgttcacacagggacaaaattgcctaacgacacatttcttagaatatgtccctgatgttaagcaatgcaggactatacttattaagcacctattatatgcccaactctctgttaggccctggagacacaataaacagactctattttcaaagcccccatggtcttaggggtaggacaaacagacaagcaaaaattactctacagttcaggacatcattctagaaaaccctagaagagaagttgcactgggtgctatggagaagaagagaggcaccttccctggagcaacggtatgctagggaagtcttcctgacaatatccagtcttctagtttgaaaaacaaaatcatcatgtgaccgtgaagaaagctcatatagccatttgcatgactgaaaaaatatgcgttggaatcgtatctgggggcatggggcagattgcattactaacacataagacaaatcaggaatatttacaattatccttaaaaatcctacatattgctcataaagtactaagtgcatgaatatgtgcatagttttatgttgtggctatatttagtaagtaatatatatgcctaaatatgccatccatgcaataaatgtaagaatcacactctgtggcaagatgctctcagtgtgagacacaaggaaaatgtgatagcaggtgatatactcatttagtgatatagcagaactgtctgcagtacttaaattctttctctctttctctgcctttatattttctttcaagcatgggtggttacatttgtctaagttaaacctctctttataacagtaaagttgtaaactttgtctaagctgtaaacttctccttacaacagaaataagttacagtttgaacaaagtttttgaaaattttttaaatcatcttaaaataatgatccacagtactgaagaactcaatgaaagagtaattacaaattgctaatgtttattaattcttaaggttccttatattttaatgccttgcaataatgaattatttaaatcataggaattataacttgcacataaaattatagtcaataattttaaattaataaatgaaacaacatagtactagtaaaagaaagaaaaaggaacatatttagagatatattcttcaaatttattgaacttcattcacccacagattttgttgttcgagctgttgcttcagaaccaaatctgctcaatgaatatcaccttctgcctcatttccctcatctttataggtcaaattccctatcactgcctccactccatgccatatgtgggcttccagaccaaatctgacttgagggactcagcatcccggggctttccacctccttcactgaagccacctgaggggctcctccgtccatcctgggcatgctcactgctcctctgacagagcaagccattgacttgaagcagttctcagagtctcaccgtctctgcaggagtgttcctacctgataatgaggctctcactcctggcatggaatctatcccactcccccgactttctatgagttccagttcagaggttctcaatgattctcaactgagaacactagaacttcttagtacagtggttctcaaatttggtttcacgttttattcatctgggaagttctgtatttttttttaataccggtgcctagccatcacccacataaattctgatttaatcgttctggaataggtttgagtcatcaagagtttgtagaaatttcccaggtggttctaatgtgcagtcagggctgaagaccactatctttgcaggcttcttgcaggcctcaccttcccagtcaatgccaagagccaaaccagtccatccaggggtctacatacacacacacagacacacaccaaacttgctataagtaaatagctcaaggaatgatagcaaatatatggtcttccttattctaagtgaagtaactcaggaatgtaaaaccaaacactgtacgtcctcactcataagtggaagctaagctataaggatgcaaaggcataagaatgatacaatggactctggggactcgggggaaagggtaggagggggctgagggataaaagaatgcaaattggttatagtgtatacttctcaggtgatggatgcatcaaaatgtcagaaatcactactaaagaacttattcatataaccaaacaccacctgttccccaaaaacctatggaaataaaaaagaaataggaattctctaacacccacaaaaaaaaatagatggtcttcccctatatctaagttgttctagttgatccagtctttcttggagggtggtataaaatgaaaggatgggtggtttcaaatttttcagactccgaaaaaaaaatgaatacaggatctgggtgggaaataatattactaagaagagggaagaaggaaaacagctgaaaataaagtcaggttaagtgattgagtccaaggtaaaatgttataacataagaagaaagagaaaagtaagaaggaaataattgagatattttaggaaagttaatgttatttaaatgaacagacttacaaataaggaaactctccatccagttattagcatcatccaatgactgaggcactgtggataatgcaaagtatacaggtcctgagccaaagtggacagatggaatctcatctctacctctttccagctctggaatcttgggcaattgtgggagactttccaagattcccacagcaagatcttttctcacacattatcttcttacaatatgagattgaatctcctcctgttttgaggtaggatctgtccttcccatcccttgagtctaggaggtaagtacaggggtgtgtaagacggtgtgggagctgagaaggaacttgctgacatgtgtttgttggggactgattcagaaaagaggtgatgctcagtctgagtatggaatgctgagatggagtttgccaggcagagaaaaggtatttcaagtaaggataaccaacatatctgaaggcttgaagatacaaatgtgcgttttcattacaccagggcttctgaaactcagctgcatggacatattcttaaaagatttaaagaatttttattattttaaagggttaatattttattcaagtttattgaacagatataattcttcataaccagagacaatacaaggcacataaaatgcacatattttctagagaaacacagagcttctgaattgaaggggacctcgggatcttttatctcagcccccatgtacccatgtgccatggctgagtgatatagtataataagcagaaagactgtgaaaccagacacatagctaaagagcaagtgcaattaaaggttaaaattagattattattccttttgatgcccttcccccatggcatatcacaaaacataaaagcaaaggcaagggaaaaaaacagcaactgggaagactataccctctagccaacctatcacaattataatgtggtatttgaaagaagaaaagacatttcaaaagggcaccattattaatgccaccaagaagggattggaaagttgcagtttaaatcattgattttgtgccagttctcttgtttatataaatatcaattctcactgtgaattattgcacctttatttagttaggaatacatttttaaaatgccttgctaaaaggtgtgattcaatggagagaaagtattatcaagtagtgcaatgatccataaatagctattattattattatttaacattcgttaaacacccacagtgagctaagcactgtaccaaactttgggaggatgtgtttcttactctgacgaggacagattaaatatgcgaaagagaggaaagcttaggatcagggaaatttatttttctactccaacatttccatgtcaaatttccacttgtcaaattaacaaaattcaagatattataatagtattaataatagttatttcttgtgttcagtgttttttacattacgaagtgttttataaacctatctcattatataacttggcatatagtctctggaagatgtgagaataagagaggtaattttatttcaagagaagcatcagctgatttgttggagcatgaaagggcagtcatactgaaggagaggggagagtttttttggataggtagtatatgcaaaaaagaattgttcctctcacctggctttcagctatcagtttccctccctgaaagcagtcactgtaatcatgtttttgcatatcaatcgagataataaatgagtttactaacatacagtttacacatgtggtatcacactatgttcactgttctgcaccctattttctcttacattttggagattatttcatgctacattattatttttaatggttgcatcctattccatatataagtgtaccacaatttatttaactggtctgttattaaagcatatttatagaaattttgtcacaatttttgtttctgaaaaattctgctattacaaacaataattaaataagtagctttgtagaaacacctctgcaagtatatatgtaagataatttcctataagtggaattgctgagccaaagtgtatgtgccttggtaatttggtagttgctgctaaattccctctggaaaatgtatactggctgcaattcctagcagcaatgtatgagtgcctgtttccccacactgtcaccaacacaatgtgttatcaaaatttgagatatttcataatctgatgagtgaatagcagaatctcatggtagtttcatttgcattccttctaagtataagattgcttaagcattagttcatagtttaacaaaaacattagtggttccttttctgtgaactctatttatattttcagttcttttataggtgggtgttcttttttgaattggtttttggcaactcctttaatattgatgaaattagtccttaatacataatctgaattgcaaatatttttcctagtgtggcattcgttttcattaatggtatttttacgttacagagttatctagttttaataacttagtgtattaatcaatcttttgtggcctctaagttttgtttcatgttcataaacatctctattaacacaagattattttttaaaaagaaacttcctagttttcacttatgattttttatgtaaattgttaatacctttggtatttattttattatgaggtagggatctaactttatttttttaatagatgactattaagtggtcccaactctattcatgaataattcaactttcttccatgagtttgaaatacttctgtcatatactaaattcccttgtaggggaagtgctttgtaaatgccatcattattcagtttagaaacgcagacattcccctaggttaattcactagagttgatggttgataataacctactgaatccaagcagatgtgtggggcaagaaacacagaaacagcaatatgcaggaagcaggaggggtgcctagttggaattaagagagcaaataggaacagaggaaaaataagattaaaatgtcagagaaaaagtagggacaactccaaaacaaatactttcatgatataaaaggtaatgagaggacacctactccaactgccctcctgataaagttcaagctgcatcacatgaactccaggacttttctggtctggtctctacctacctctctagcccagcgtagatttctcactaattatctttcaggtttcagcttgaacattattttccgccatgtacttccaagacttggcaaagaatgaatcaagtgttccttttttggtccctgcagcattctgtgcattgtattgtctggtctctttcacctctgttgtggacatttttcttcactcccagcttttagtcatctctgtcagttaccaagtttctctctggatgacttcttctcttacactaagcccacgtgcttctgatggcactgacttgaccccatccctgaggtcccacacgtgacctaggcaaagctgcttgatacgagtcactctccacaccccagccacaccccagtgagtggttcagggattggcatgtgcccaaggagagctaatgtgacacagtggaacttggcctggggagcctgaatgaaaactcaaaccagaagtcatcttacaacaacgggggtctacagagtggaccaaaaatgaagtagaaccaagaaatggagggacagggaaagccatctgaagccctggatcaaactggaaaccaatatcatccctggattatttcattactaataaattccttggttttcttcacattgttttaagctcaattttctgtcacttctagaaaacgactgcaacttcttaacagctcctgaaggttgtttcttaagggaagaaactgtgtcttaatgctattgtattcccagggctccattcctggagcacagcaacattcaataaatatacagggaagaaaaaggaataaataatacgacaaagttcttttaaatcctaaagtaacaactgcttccaggtatggatattctacttatggaagatcactgagttgactgatggcagaatctggattcaaatctaggctgacccgggcccaaatccttggtttgctcacctgtaaaatggcaacgctttgtggtttgatattaaaatggtgatgataccctcttttattgccggaaccaaggagtgtgccaaagagaagaaggttcctgctttgccaaaaaccctcaagaaaaagcaaagaagttttgcagagctgaagatcaagcacctgagaaagaagtttgcccaaaaggtgcttgtaaaggcaaggagaaagcttatctgtgaaaaactgaagcactttcacaagaaatatacacagatggacagaatggagattcgaatggccagaatggcaagaaaagctggcaacctctatatacctgcagaatccaaactggcatttgtcatcaggatcagaagttccaatggtgtgcacacaaaggtgttctgaaaggtattattgcagcttcttcacctttgtcggatcttcagtggaacctttgtgaagctcaacaagccttcagttaacatactgaggcttgtagagccacatattgcatcagggtacccaaacctgaagtcagtaaatgagctaatctacaacagtggttatggcaaagtcaataaattaatcgccttgacagataacactttgctcaatctcttggcaaatatggcatcatctgcttggaggatctgattcatgagatctatactgttggaaaacacttcaaagaagcaaataacttcctgtggccctccaaattatcctctccatgaggaggaatgaagaaaagaccactcattttgtagaaggtggagatgctggcaacagagaagaccagatcaacaggcctattatgggaatgaactaaggtgtctaccatgattatttttataatctaatccattagtaaacagtaactgttttcaaattgaaaaaagtaaaatgataataatataacagcacatatcaaatacttattctctgttagaactgattatttcacaccttttctcctgtagcctcactgttcttcagaaactttatggattataaaaaccatgaactctctaaactctaaaagaaaggcatcatggatatgagcaattactctgatttccgcaaataaaattgtttcatttagcttccaattgcctctgctaatgagagaacgtaaaattgtggataatcaaaagtcattgatatgtgtttggagaccttgttgtatgatgagttcagcagtaaattttccttgctaatttcattttgcctccagtggcaaaaaaaaaaaaaaatgagtttggattgtctgagcatatgttaactgggtgatgaaaaagataattattgtgctggacatgaacagaaatcattttattttttaattttattttattttagattcagaggggatgtgcaggttttgacatgggaatattgcatgatgctgagatttagactctagagattccatcgcccaagtagcgaacacaggtagtcttttggaatccccagtgtctattacttccatctttgtatccatgtatacccaatgtttagctcccacttataagtaagaacatacagtatctggttttctagaaaccatttttaaatgtccttaaaatttacttagtgtaatctacaaggcagataacccacaagcagataattgaggggtgaatgtcaactgaatataagaaaatgtttgttctattgcattattatgattttaaacagagcattataattttttattttgcaataattaaaagcaatcttacctactttagttggtgggattttcattaagtgtaaaattttatatcacttgaatattctcatgtttcaattgccatcttaaaatagcacaaataatggctgaaacattattcattctattcataagttaatgctgcttaaattctgtcagtaaaatgtattaaaaattctttatgcattttttcatcccttacattcttagctatgcaggggttaaaggtcatgcagaatacttcaaggtattgtttgggtattttcaggggaaaaaaaaggttacctaaactgagtgaagtaaccaacttttacaaggctcttctcatctcattacaactggtggttgtacacattgaaatattgttgtatggggcagttttccaagttgtatgaaaagccttgaaatatttagcattttactctattacaatttgagaaattatattaaaaaataaagaaacaaaacgatatatgtcattgcagcactatttattacaggtggaaaaattctaaatttctaataataatggcatatctgtgactttaaaaataatatttcaaagattatttcatagccaaacaagctaattataatataattgtttttaagtcttaaaaaaggcagggaattatcccagatatctgtatgagtgtgtatgcgagttgggggaactctggaagaaaatctgccagtgattactggggttatgccatatagatgatttttacttctcattttcaacctgccaaatcataatgagtttctgtaataaatctgtataacttttatcagaacaaattctgttttcataactagatcctagttcccagagcaggcagattaggtaaacagccctctttacaagatggtttctaaaaagaggcttgaacacagaagcacgttctaccactgctgtttctagttagctagttctttattacagttgtatttcacagcttagtctataatatagaaattctctagcaaggttggatacctccttactatttagtaggaggatttactttcctggggggtaaaaactgtatcttcattctaccctccaccttctccttttaaatccttggcttttaactccactgtaggttctatgctccttgtctggaagctggaagacctattaggaggctgttgcaatagtctgagcaagaaataatgagccagaacaaaggcagtggctgtgtgtgtgtgtgtgtgtgtgtgtgtgtgtgtctgtgtgtgtgtctgtgtgtgtagctgagtgggaaattcagtaagtctgaggctgacagggaacgcaggagaggggatctctccccactgctgtgctgattacagctataccccgctccataaccttgcagccaccaactctcataaaatctaccaatcagacctaaaagagatagagcactgtaaccacaaatgtcctggccatcagcatagagactttccaaaagacccgccccaaatacatatgttctgtagggtcttagctcaccctaacttaacatttgcttcattttaatagtaaaaatcacagcccaggaaggagatttaagatactaatgagacataggacatataaagaagcatgacaagagaccgcacaggtgcagccaacagaccactgcaaacatgcaataatgttacctggaagagagcttagaaagaatacaagttcaagctaacccactttcaggcagccaacagcagatctctttctgctgtagtttccctttctgctccaggtgaaagccgcaataaactgccttgctgaagcccatcttagactctccatcagtttctattttctgagggtagagaaccgactggccagtcacaagtccacacggcccatgtgtattctctgcctagaataagtctccttcacctctggttgaccagatccttctatccttcaagttcccattcaaacatctccttctccacaaaacccttctatacccacagctggaagtaattttccctcctttgatttttatgtttttacctttttcatgtatgtatatatttttttattttgaaacaatcaaaattgcaatacagagaacttttttaaaccacttgagagtaaattgccagcctaatgctccatcacagctgaatacttttgtgtgtatttcctgcaagaaatgagacattctttacataactacagtacaaacttcaaaatcagaaaattaatattgaaatattaatgccatctgttcctcagtccagtaatgttctttatagcaaaagaatcctgttcagaatcaagtgttgcatttaattatcatctctttaatctcattcaatctggaatggggtctcagtcttaaatttcatgaccttgacaatttagaaaatacagactaacagagtactcatcaatttgggttttctagtgtctcctcatgactagatccagtttatgcaccttcagtagaaatatcacagaagtgatgatttgttcttattaaatggtgcatgattgcaatttgttctattattagttatgctcactttgattgcttgattaagatgatttcttccagtcttctcaactttgaagttattcttttcccctgggtaattaatgatattttgtagagatatattttgaaacttttaacttattcattcacttatcttttgtcagtatggactcactgtttattttattctataagctctaatccattactatcattatttatttttaacctgaaattgacaagatttggccagcagaaaccccttcaaagtggttcctgtgtactttgatacatcctcaccattctttgagcatttctttgctttatgttacaagatgttccaagatcattcgcattttctcttcccccaacctggactcatccatagttctacaaggactcctggttccctgaagaatggtatttagaaaccaaggtctgagtcctaggagtttttattgcatttggggtggtactgctccgaagactgctcagtgcacaaaacttaaaatcatgggaatgtatggaagtgcacacatgtataaatccacacgtttacatcaatagttattatctacctgtagatactgaaaatcatgagttcacactcaaaggttccaactccattgagtttattccagctttctccctttccatatatgcaattcctatttccaatagtgaaaaacctggctcccattatccttaacatagttacttacttaaacacttccatatatgtctcccatctttggaactatcaacttctcacataaatatcctccttattccactcaggtcatgattgcacatggacatcctctcctgtatgttcagtctctgaaacccatgttcaagtcactctcccctaccgctccatctatatattctcctaagcctgtgcattccctgaaaattccatgccaggccacccaccccctgtgatatccttgtcaccctgcttgggctctgttacccactttggactatcctatatgtgtaccctcctcactctaccaggatgcccgtacatggacatcctctcactctgattacaaataataaaattttttagttaaagaaaaaagagatactggtaggatttttagtctaggaacatcctaataccttaaggtccttggccaaaccttaatttattagcatacgtgaaacacactcatggaaaagtgattcctttccttcttttctgcctgtgagaccagaccagtcatcaatataatcattgtttaagggaaaaagtgtattagtttttttattaaatctcaccttctctctttctctctctctctctctctgagacacacacacacacacacacacacacacactctctctctctctcccattcctttaccatgaaagcttatttcactgttgctcaatcctctgtggatcaaaatcggcaaaggatactaaaagtactaatatttttcatggaaaacaccgcctattgtattctgttgctggaaagattcttccacaagactgatgacagaaacaaaggaaatacaaggaagaggttatggaaaacaggagggagagggatgagtaaataagaaaaagaaaaggtgggaatgaggaaagtagcaagaagggaaatggaaagaggtgatctgggagagaaaaaccacaggtgggatgctaaatgggagaaatgtgaaaagaaagtagtgggagtggcattcaggagagtctgacttagccaccaaatcccatggcaaagagtgccaactttattatcagccccaaagcagtgctactgtcaaaataaaaaataaagttacctactccaaaatcactgacatgtctaagcaagtaatggagaaactgttggttcatacactttttgagaaccaaacttctgaatttttgtctacatacttgtttcctgacatctttaaagaattgctgtttggagcatcagttttggacaccacacatcaacatctccaagatggtgaaagagttcttggttgaccaaaactttgttgaagaaaaatattgatatgtgtataaatggaacgcctgcactattagcatcacatctgattttgctgcttttataaagaaagaaactacacatttcatcacgtcaatgtgtctgactcaatcccctaccaacgatccagaaaaatgtcttgtctaatgctaggatcttgtcaaatccaggttatgaaatcattgcctttttatcactttgaattcaaaaacatactttaatatgaagttattctcttcgtattcttcattatagacctaagtttgctggatttccaaaaagtagtttttgaaacacaataaaacttaagggaaaattttgctccttttacagaaaaagaatatcacttcttagaacaatttttttaagatgctctattaactacctttattgtgacactttttaatactgtatgaaaacctcggtatggtgccaatttctttttttccctcttaacttttattataggtgtggggtatacatctgcaggtttgttacatgggtatgttacactcagggagtaagcttagtacccaacaggtagtttttcagcccatgcccccttccccctctccctcctctggtagttcacagtgtctgttgttcccacgtttgtgtccgtgggtactcagtgtttagcttccacttataagtgagaacatatggatttggttttatgttcctgcattaatttgcttaggattatggcccccagctccatccatgttgctacaaaggatattatttcattctttttatggttgcatagtattccctgtatatgtaacacattttctttacccaatccacaattgatgggcacctaaggatgattccatgtctttgttattgtgaatagtgaggaaatgaacatatgagtgcatgcatctttttggtatagtgatctattttcctttggttttatacctaataatgggattgctgggtctaatggtagctctaagttctctgagaaatctccaaactgccttccacagtggctgaactaatttacattcccaccaacagtgtgtaagcgttcccttttctccacagcctcaccagcatatgttgttttttgactttttaatataatagccattctgaatgaatggctgaaatggtgtctcagaatggtgagatggtatcatattgtgattatcatttcgatttgcatttctctgatgattagtgatgtggagcatttttccctatgtttgttggctgcttgtatcactccctttaagaagtgtctgttaatatcctttgcccattttttaatggggttatttgttttttgcttcttgatttgcttaaattcctttatcagatgcgtaatttacaaatattttttcccattctgtaggttgactgtttactctgttgatagtgtcttttactcacagaacaatttgatgaagatttattccatgattagtttaattagcagatcttttttgctgaagtaaatcattctatatgcttcctacagatgttattatagatactactgaaaatatcagtagggcacattagttactttcccaacattcatttcactttattccttcctaatgaaatcctgattttagtttgtacattatttcccccactcaccaaatgactgaggaaaacaaatctcattgccaaattgtccctccttagttgaaaccagtcagcacatgacactgttctggctactgttatataggtagaggagaaattacatggcctgcatcggtccaatcatagttaggggaagaactctcttttacaatgttaagaacatacgttacatcagattctcctggtaggtgacttgtaaccataggagaaccagtctgaattccaggctgtctaatggagcagaaatatggaaagcatttatgtcttgataacattatggatcactgagtcaccaccctgaccaaagctgactctacttctggactctctgttatgtgagataataaatttctttactgtataatttgtcattgacttgggcttttgtacttgcagccagaaatatcctaattgatcaaatcaagtccaacctcctgtctgaaaactgaaattgcaagcagacatgcatgccaactttgaggtgctggtgaaagtgtttctgcaggttaggccttcacagcttccctgcagaaagaaatctgaaaacactgaatagttcccatgcaggtttcttctgctcagataattttaaagcttaaacatgacctcataatcctttccttcctggcatagagagaattggtaatgccagctttgcaaggtaacctcattgatttgaagaaaaaggaaatgatgctacacaaattaaacccaagagagtcttggagaattctgatgttctttgacagcaatgtacctttgagtcacgggttttagtaccagctgccatcaaaataaaaatgtcaaaatcaattgagtgtccaagataattttcacattgctatgtcagtctctttttcaagtttaacatcagatggcttaatttgtacagagttaatgtttactcttaggattttattttgatttttttgcacagtttagattcatcttgattatttcctgaaaatcaccactaaatttacatggcttttcccatgaagaaaatattctttgaacaaaatcaacttccagttcaataggagaaaccataatcatatgcaaatttgttatgtatgtgtatatacttttctgaaaaggggaattatattttcatctgattcacaaaggagtccatgactcaaaaactatttctgaaggccaaatagtaactatagatggtcagagaaattaccgtgaaagaggaaaagagaagaaatgaaataagacgtattttttaagttttggcctggttgagaggacagatataaggtgactgcctcttggatatggcaaagtggtggtatatatatttgagtctattacagtatagttggaaaacataacaagtaaataagaagtccctggagactttaagacatgtaatgacaatatattgctgtgtgggtacaaattaggtgcatgcctggatcaatcaaagtacttgtaggaaacttaagacacaatccaaaaaaaaggtaattgaagagattttaatgaaagtactatttacaaaagagtaaaagatgggattaagggaagccacagggatggtgaaagagcctaggattgacaacaggagaagccattaccgcttctatgccgaagctagcctattgagagtcatggtggtagaaggatgcctgacaggagctatgatcataggtggaaggttacagaaacggtccacctgcagcaccacaggaaaggagccccggaaataaataccccattctcactctctccccataatctgaccgcctgccaaagcctctcactgaccaaatccaaacaagagctgagggggtggaagctggattatcttagctgacaagatcagtcctttagaatcaaaacagggtcggccaggcgcggtggctcacgcctgtaatcccagcactttgggaggccgaggcgggcggatcatgaggtcatgagatggagaccatcctggctaacagggtgaaaccctgtctctactaaaaatagaaaaaaatagccgggcatggtggcgggcgcctgtagtcccagctactcgggaggctgaggcaggagaatggtgtgaacccgggaggcggagcttgcagtgagccaagatcgagccactgcactccagcctgggcaacagagcgagactctgtctcaaaaaaaaaaaaaagaaaaaaagagaagaatcaaaacagggtcatggatgaagagggacgtgacaaggcaaacaggcaccacccaactcagacacggcccatataacagtacaggagggactctcaataagaaatagagatatttagttccacagtagctctgatacacatttttggcaaagatgtgtatttcagaatcctttccgtttagttaatgctagtttttagtcatcatactctatgttgacaactttacggatataaacaaatacttattttataatcattaagtttctgatagtaaagctaatttttcccctcaggcaaaaatattcttctagtttcatagctttggcagtactttattcctcttaaagagtaaagtgtttatgtaaactggaaacaattgttttgattccatctccaaattatactaattcctatgagattcacagttcccttttgagttgttatgaacctaaactgtgtccaggagtatgtgtgggtgggtgtgtataatgtactgaactgatcaattgacagtccgtgtgtacatgcacctggaaggccaccactagctcatcatgtctgtgtcttttcagggatggactgcataggttgtctggtgcagtggaaagagttctgaagacactggtcatgatctgtcttttcactaagcagctgtaggtcttttggcaagtccctcacccctccaactactcttcaaaggagtaatgggttgaggcaacagaggctcagatatccaccgactttaagttctgtggttcccatgcctgtgcctgatcagcatagctaatgggaacatccactttgctgcttactgactgctctggtttgaaaagagctttgttttaaacttatctagagtgctaactactctactttaaattaaatattagataaggaaagcaacagatgacattaaaatacaacaaatcctcagtgactttctgtgggtctaagagttacagcctcacatgaaccttaggatttccgtgaattgcataaattatgcttaccatttcgcaggtaaatatttacatgtccaagtaatgactccacaaagctgtgagaaaggaagaagataattcatgccctagaatagatctgtacattgtaattcaggtccactggagaaactctatttactatcatcttcaatgtcctggaatggaggaaggagctatggagccactgctgaggccaaggtattccatgccagctgtcacatgggtatttgtacaacattcttgcatcatacaaataaataattagctacgtatttaatacctactgcacactgtgtattacatatattgtttaattctcataactgtcctttgatattatctccaatttactggtctcaaagaaatcaagtaaattaaccaaagacactacctaggaagggaaagagtcaggatttcaacctaagattctaaagctgatgcctctatccttgttaccctagtgtctccagcaactctggccagacatattcactatctctcaaacacttccattggtttttcacagaaaatgaagctgttcacttaactttgatttctcccttgagtgatgtatctgaacccttagccctccacatgtgcctctagcaatatctactattccctggagaataagaaccaggtgggctgggcctggcctcaattgccagtattctccagctccatagcagggcaagcaacacatccatgtgacctgtctttacgcactagaacttctatctcttgtctttcttctaaattatagaccatattttcctgtaggcatctacctcctcttcccttccaccataattacccaattatctaaacaccctactccctacttcaactgtctctagagaacattcaccttctaaatgtgctttagataattttatacctttactgggctttgagaatttttttaaggggaggcactgccctaacccactctccttttgtcttaggttgggtttcttggaaatagattctaagatggagaattgtgtgcagaattttggttgtgatgtgctctcaggcgatacacctgcaaggaagtgacagaagaatgcctgaggaggagtgagaatccaggaatgggtcagccctgaagaggggtctggggcaggcactgtggtgtgcactgtacctgctcagattggtgggcctgacttgtgtcttcagcttaaattacctattcctcttccagacaaaagatctttaaggtcctaaacaccagtctggaatctgactatgcaaaaatgaaaagatcctgagctccctctccagaggaactaagtgaaacaaagaacgattataaagtaggaaagttctaaaaatagtaagatgagactgggtaatttgaatgaaagccagtcaagtctatgtggaatatagcatcttactgattcattatcagcccatataatttaattacattctacttaccatgcaattttcacatcctaaaccatccagcgtgaagtctatgttatctgattaaagaaagaggaaagggagagaagggagtgagagaaaaagagagctcctgaagccatgcaaaagaggagcttccttaaggatggcagaatgcattgcaaattcagaaacatatttaacatataaaagaaataatgtaaatttatctcttgttttctataaataagccaggtttgattatcttaagctattaatacaaatattcttctctttgtctttcttaacttgagccatttacaatttgtaacacagagaatcatttttcagatctaacttaacatgtaactcttcattgtttcaactgaaattagcaaatcccagaaagaaaattcttccctaagaaatcatttcttcaaagtgattatttaagagttgctaagttagaaacatacatatcactatcactatcttctgatcatggtatcactatcttctgatcaaaatttaaagatattcatttgaagaacatttatacctcaagttctaggaaaaggaggttttagtgactgaaagatgttgaggaaaatgtgaagctcttaattaaaattattgagtcacgtgaatatactgaataaaatggtggttcccagaagctgggacaagtaatgagaaaggggaaatgacgaggggttggttaatgggtacaaaaatacagttagtagaaataacttctagagcttgataccacaatagggtgactatagttaataatttttattgtacgtttcaaaatagctagaagagaagatttggaatgtttccaacacaaagaaattataaatgttgaaggtgatggatatcccaatcacccagatttgatcattatacatcatatgcatgtatcaaaacatcacatgtaccccataaatatgtacaacttattcagatctttttttctatttataactgattgaataaacctattcattttactaaacaattagttttcaaaaataaccaatatataaaactgaagaaagtcaaagaccatatcctgaattacaaaaataatattttaaaatatatatactcctagaattatttgactttcacttaactaatactctttgtgatcaatccccctgattaaattcaaatttatgttaacctatatttacatttatttttggaggtactctagaaaagttttccaaactgcatcctagttgctgtggcctttggtttgatggctttcacttttgagttcaaacctcatttcccaaatacattctacaactaggcatatttatttagaactcaaaaggccaccatcttcagacttaagaaacaaaagcagcagtggtttcattatatttcatatatttcattatattttacctgtgtgtaaaatataatactgtcttcttgggcgaaaggtcatataattctactctcatgtggatgttttccacaaaatgaatacatagatttaaactgatcaatccacattctttcaattgacctctcttaaaaaccaaagcacagccatttgagcttcagtgcttagagcaactctttctggcctgtgtaaggaatttacccatgacttgggttttaatactgtactctaaccagcagcaagagagagccaccaacaagaaaaaacagggatgctgattttaagaacttaattacaagaatttatcagttagaataaccctaagtactgtaacaaataaaccctgaaatgtcagaggcttgacagagcagaaggttatttcttactcagataatggcccaactctggaactcctaattgggaggtagcttttctctacatggtgatttgggaaacagactccttgcctcttgtggtcccacagggtctcataatcttctgcattttgccagtggaagaagaaagcatggagaaacatcctgtttcttaaaaactgtggcccagaggtaacacacatcacttttgctcacatttcattgatgtgaaataatcataaaatcaaactaagatgcaaggtggtgggagggggagtgtgtagaaaatatacttaaacctaaactatgggacaaggagcacaagttttggtctacaactattcatcacaaccacaaacaccatcaagcaagaatttatcaacacctattttattctggatgctgtggtaataatcaaagacagcataggccaagtgacaataaagaactataatgtattcacgctgtcattcagcaaatgcttactaaacatctaccggctggcacttgctgggccgtaaactaaggaaatgaagatggtgctctcaatcccatataggagacaggcctgagcagtgctgggttacctcaaagcaaatcaagtatatttttaggattccaatgtaggagcgccaaaactagagacagaaaaaaaaagaaagtttttgaaacaatttgatccctgatgtgtccttaaatagcattaaaatgttcatcaaaataaaggtaagaactttgtaggatttctttatacttatgattaacattttttaattatgtgtatagggaacatcaaaatatttttataatatcctagccctttaaggtatcaacttggtccagatatttaattaagtgtaaggaatgtcccaaaagacctcacaaatgggatggaatttgagtgccttagaaaaaaaagcaaggctcagataagcagaagatatgagggaaggtgttccaaatcaaaggaactaggatagcgctagtcagcagagacagcatcaggacaaccactatggctgtgaaagataaattaactgggtgatgggtcctcttaacagcccagcttcactcagatctgccttccctgttgaatgtgagcacctcaagggcaaggaccatggccatcctttagccccaattaccagtatctacccaggtttggagaactgaataaaattcaatgtgtgcatcaacttgcttcttttaaatgctgcaggatacattgcaacaaggtgaaatttttaaagcatatcttgactctggaaaccatatgttgtcaggtcaagatgggaggcatgcagtgctcttatctgtctcatatttgaatgcttctgacttttatcacagattaaatttactggaattcatttatttctatacatttctccttctgtcatcccctcttactttgtgtagtaaatatgagatatttttctccacagactcttcacctcagaaaactgtcattatctattctgtcagtcctaaacatctggagaattggcaaaactattagttcaaaatttatgatggcattcttcacattttacagaacaaattctggtaatgtttactatttccaatatctggaggactgttatttactatatatgctttttttcacaggagaaaagtttatatcactaccttgctatgcttcttagaaacatttttaaagtattatatagggtcacaattctatcagtgtttttgtaagagcttgaattcatactcatggtgtttgaaagaatttgtttttctctaggcagagctaagattgaaattagatttcacgaagatgacagttttcaagacatttgaaggcagtctttttaaattctaggaaaataaaatatcttagttctgacattcagatatcaatgtaggctagttgctagtgagtgagcactaatcagtcgtaactttcttctgctgaatctgaacaccacctccaaatactcagcccagcactccatcagtaagcacccatgagttgaagtttatatgaggtgagactattcgcatttcccattatatctgaagtacctcacttgtagcagttaagaaaaataaatataatcctataatatttacagagatattagtaccctatcaaattctgcttagtgctactaatccccatagaccctttcaacactttgttaagaaatagtgaaatttgattaaccctattctagaagggattgtagttaatgagagcttagcaactaagaaagttcacggggggtaagaagaaacatagcaaagtccccttggcctctttcataaccatactattgaggaaggaaaaagaaaaggaggcaaaaattgacaaagtaaatattggaaacttggaagtcagaaaatatgtttatacaaagggaaagcaaaacacatttactgttgaggcaagacaaccaaatacaaagtaaataaacacatatagaacaaatatggcaaatatatagaatgcatgctccccaacccctttccacagccatggcaaataccaattatcaattcacagcaattctcatgctgagcccatgtgcaatcttagcccaacacagtgtcagtataatcactgaaacatgagatgagataaggcttagttgtcattcccagtcttgcatctgttgctaaagctttcttaggttttttactatactgtatataaaaagctagggctctccaaggcacacaagtcttaaaacttgccacaagttagcagtgaggcagataagctgatctcatccaacctcccttcaatagcaaaggaaaaagaaaactaacttatatttctctaatgctccgtaatgtataaggagctttatcagcactacccaacagaattttgagcaataatagaaacatatatatatatatatgttcaatccaatatggcagccactaatcacatgtgcctattgagcatttgaaaattagcactagtataactgaggaactgatttttactataattaagtttaactggccatgtgtcttagtcattttgtgctgctacaacaaaatagcaagatgggtaatttataaagaacagaaatttattttctcatagttctggagcctgagaattccaaaatcaagacattagcaggtttggttgtctggtgagagctacatcctccacagggtaagaatacagtgtcctcacatggcagaaggcagagaggcaagctcaccaaatgtgtgaaaccttttataagggtcttaatctcattcatgaaggaggagccttcacggccctatcacctcttaaaggctccaccttttagtactaacacattggcaacacctgactttcggagaggacatagttaaaccatagcactatatatggctgctatattgaatagcacaggtatccatattatctaatttgatcttcacaataactttgtcaagtaggtcatctccattaaaaagagaaggtaaagagacacagaaatattgacttgccaacattacaaagctagagagtgaccaaatgtatacttgaatctcattctttcagaatctaagttatcagacccttctttggtaccacatcaaacttgaggtaggtatggatcaaaagaggaccatgccctgaaactagtggttctatgcagcccactatgagtttaccacgggaagtacactgcaaagaactaactctgaaaatctgagattttaccctatttgtaagctaacaaattagcatgccaatttcatgaaagccagcagaacacagaagactcctggatcagagtaaaaggactttattactcacagtaatagcagtagacagggtatgaacattttcttacagcaacttcccaagcccgaattcccacagaatgatggatgcagagggccggatgactcttgtgcatgcagtgggttgcattacagtttgcaaacttaccttagaaaacctaaatcatttatagtaggcagaaagcatgcctactccttattccaaagcggagtattatctttatcataataaacagtaagcatgactccctttctctatatctatcctccaaggatgctgtctatacaagcatccttgaaatgataacctgaaatgaaggaagtcccaaaacatgcataaatgtgagaaaccacacaccacttcttctcctgtttggtgaaaaactattttctcctgttttgtcaccaaagagtagaaaataagccaagaaaagagaaagatgactaaatatcaacataagagccaagttgaggtgtaagtgtgtatgtttgatagaaagactacgtgttcaaagttaaaaccaggaattaatgttaagccaggaaattaaagtgaaagtaaatttgggaaataatagtgccatataagtgtgatgaatcactgacatttttattgggcattaacaacacgtttttaaatataatttcccccaaactagaggctacttctttcttggaactgaatgataaatacatgcacataccccttacccaaggcagccatctgttctaagggatcctccaggttactgtccctaccccgacaccacactgcctcccagatgtccttctccctgaagccagccccagatcttctctccccaagcagctctcctttttgcctgtcttcctgagtaccggtccccaaatcaccaaattctaccttgaacatattgaatgaaagtgtgcagtgccttatgccctgatgagaagtggtcttggaagatgttttctgcaccaacttaagaagctatcacaaaatcatgataaaaaaaatgatgagctatttatactttgcagacataggtggttgttggaagaaaagagtgccttaggaatcaaataactggtattggaggattcctgtgactttgtaaaattcaattaaatatccaggggaaaataatagacaacattgtcacctgaggatacattattggtccttgttgaaaaagcagtagtttctaaccagttccttcctaacctatttgccattaatttctggaagttacaaactgtaataacaattaccataacactgactgtagcataaaaaccataggatgttagccccaaaagatggtcagaaataatgaggtgctaattttacagatagggaaacagagacctgaagcaaggagtgtctttttcagagtcacacaaccaatcattaatgtatctaagacacatttgcaggaggattctgttcttcactcctccatttttatacaacatactatctcttgcttttcaacctacagtaagttgagccaaaaaaaaaagatacctacaaatctccttcttgaacatgccctttgaggtggctggaacagtatcaagtggtctgagatagcaatgcactaggtggaagcttagatagatggcactaagtggaagcctagtaggaaacctcagccctgcaggcagcttccatgtgtattcccttgggtctgccacaaaagcatgttgcactacaaaagattcaaaaggcaaatgtgtgcacagcacaggagggagcccagttcttctctgaggagtttcctacttcagtggtgttattaagctgggtcaaaagaaagtcatttcatttttttaaaatatgctaatacaacctcaagcaccagctagcttaaatgataggcatttcataaagttcatttttattattctcagctgaaaagtaaataacaccctacaggtgtccttcatataaaaatgatgtatttgccttcaatggagactctgtattgactaaaaccttatctgtatttcacaagacagatcatttttccccatcacctttcaaagaggtgttgttgccagtctatacaggacaaacgaaaacagtctaataaaagaaatggttcagcaggaactaactgaaagagttcccagtgaccaaaactggaacaacttgagcaataaaataaataacctagtattggattataacccaaagaataaaataaatagccatgagttcatacttatataaataaacataaataggcatcaatagtgtatttataaaataatttccccagaactaaaggctactgcccccttgggactgaatcataaatatatgcacagtaaatatcaatataaataaatgactgaacaaataaagtaggggagaagagataaatcttcctttcagaattccatataatgtatgttcatattctccctctccaaaaggcagagcttaattcctcagttttggaggtagactagacttagtgattcacttcttaaaaaatagagcagggaaagggaaaaatagtaactttatagtggagaatcatggcaaatgctaccttaaccaaatgatgacagttaacaccaccagtaatgtcaagtgaatatcatgttctctaatatgatctaatgagaagggcttgacttctgagatactcttcaccaaaacttataaccccagtctaaacatgagggaaaacatcagataaactgagatcagggggacatttttttctacagaatacctggccagtattccttaagacagtcagtcatgagaaacaagcaaagattagaaagtcacagaccagaagagactggggagataagaaaaattaaatacaatgtggtgtcctgaattggaacagaaagaagacattaatgcaaaaactattaaatccaaataaaatctgaagtttagttaatagtaacgagccaatgtctttttcttaattttgaaaaatgtaccatggtaatacaagaagttaacaatgggtaaaactgaatgaggggtatatatgaactctctgtactttctttacagctcttctataaatataaatttctaccaaaataaaaagtttatttcttaaaatagatggtgcaaatgtatcttattgcatgctcttccctggagcatggtagagttttatagtgaatgcattgccaaatccaaggaagacagaagacttgagaaaactaaatactttcagcagccaggggtggagtggtgacaacaagctgtagaataaaaggaaaagtgatgtttgttcagtgaagaacaaactaagtcttatttgtgtagtggtctcagaagcagaatatgttctaaacaaagagttaaggaaggtaaaagctcaaaccaacaagtaaaccagatttcacagaaacacaaatgtgtagcggctgtccaataatgattatgtttaatagtagaatagactccagttgcaaacatatgttttatacaaactcttcaaattggagacatttctctaaattttccttgtaaattgtgcaggatattacatctgactttcatattatcatctcaaaagtggtgaaaccattttgccaatcacttgcatcacctttctgccaccctgccttctaaattacttccttttcccactcaggccatcctctactttcaattccaaaggtttcagttcctacccaaactgtccccctctacccatcccacttacaacccttagtctcattagaaaaatctcaaccacccgcttgcctttaacacctttttctggatttgccttctaaacaataatcccttcgaaatgactttgtgaatgaatgcaactgatttaaagggtaaagagaaatgtatctgctttctacaaaagctttatgtagatagggaaaattacttgtataacttgccctttttctcctcatctttctatagaaacatagagttgtgtttccaaaaattccaaggaaggcctgggcatagcttgtaatacatgtggtatggaggttattaaaaacagtttttcaattcaagttctcaagcctactatgaatgtttaccaaagaacgacgtgaactggactgacaaatgcattatactttggtcaatatatattaggttcacattttgttttatcaccttgatggctgaagaataaatttaaaagggatggactaaacattcaaagacgcaaacacgagtaaatacttcagagttcaatatgtagataacaaatccatcagcatataaacatgttcagcaaacaacagactgaacaaatgtttattgagtatctcttaggtgtcaggaaatgtgcaagcactttggcaaatgctgtcccatttaattctctctataaatgtgtaaggtaggtataattatcctcatttttcaaattgtaaaaccaagcttccaaagattaagtaacttacccaaggagaattgatgtgttacttaagtaatattagttccaaaatatcagtggcttaacacaataaaatattgaaatgtttctcactcatatcaccattcaatgcaagtcagtggtgggtgtggctaagaatattctatcccactcgtccattcagggacccaaaatactttcatcccatgtctctgccctcccctaggtccccagagacctctccatccaatagctagatggagattaagagcacattaaaggtttttttgtgcaagacctggaagtagcacataccacttatgctcaaagttcattctccaaaagaagaaccagaaaaggaacagccaagcaagaagaaaactttcagacaatgggtaaaactgggtgacagtatataagaactctctgtactatctttacacttttctataaatataaaattttaccaaaataaaaagtttatttaaaaaaaaaaagatggtataaatgtatctcattgcaagctcctgcctggagaatggtggggttttataaccaatgcattgtgaaatccaaggaggacagttaaagaaaccttgggaaaactaaatgccttcagcagccaggtgtggagtggtgacaacaggctgcagaatgagaggaaaaacgatgtttgctcttcacagagcaagtgaactattattcgtgtaggagtctgagaagcagaatatgttctaaattttactaactgtagccactatatttctaccaagcactacccaaaaaaaaaaaaaaagtgactctatctcctcccctgccagaaaaggccaaatttgctttccttctaccactgcatggcagcaatcatccagcactcctcttctctccctggagcaacgtcagaggaagactgctacaacagaagattcaaagaagatccagagtctcataatataatacccaaaatgtccaggttgtaataaaaagtcagtcatcatatcaaagaccaggaaaatttaacttaaatgagaaaaaaaaaatctgcagacgaaaaggatttttgaagcccatagcaaaaacatctcagtgaagaattatgagcacacttgaaacaaataaaataacagaaaatcttgtcaaagaaatagaagacataaagaagaaccaagttgacattttacaatggaaaaaaatacaataactgaaattaaagagctcagtttatggactcaagagcagcatggaaaacagaggaaaagatcggtgaacttaaagatagaaaaatggaaattacctaatctaatgacagaaataaaataaacagaagaaaatcaacagagtattggggacttgtgagatgtaacagaagatctaacatccatgtcagtggagtctcataagggagaaagaagacggggctgaaaaagtattttttaaaataatggctaaaaatgtcccattttggcaaaagatagagaaaaagattcaaagagttgagcaaaccacaaatataataagtcaaaaaaatcacaccagacatatcgcagttaaatttctgaaaattaaagacaaacaaaaaatcttgcagctgtgaaagagaaatgacaccatacctatcaggagaaaaaaaaattgaatgacaaggtttttcagcagaaaccatggagaccagaaaatcctggcacaacatttttcaagtgctcacagaaaagaactgtcaacccagaattctacatgcaaagaaaatatccttcactaatgaaggattcaatacagtcttaggtgaagggaaactaagggaatttgcctgaagatctacactaaaagaatagctaaagaaagttctctagacagaaatgataaggagaaatcttagaccatcaggaaaaaaggaaaaaaacagaaagagtgaaaatatgaatcaatgaaatatgctttcattttcctcttgttttctaaattatgtttgatagttaaagcaaaattgtaacagtctgatgtggttctcagtggatgtagaggaaatatttaagataattttattataaatggaaagagggtaaaattatataaaggaagtaaggtttctatactgcacttgaactggaaactggtaacaccaacagatgggataagttgtgtatatatcatataatatctagagcaactactaaaagagctctacaaagaggtaaatccaaaaacactaaaagtaaattatgatgaattccctttaaaatgtccccaagtaacccacaggagctgagagaaataaacagaaaaacataaacagtgaaaacaaatgaaaaccaaaaaataaaatggcatacttaaggattaacatatcaataattacattgaattttaaaaggtctacataccgacccggagccgtggctcacacctataatcccagcactttgggaggccgaggcaggaggatcacttgagctcaagactttgagaccagtctgggcaacatagcaagacctcatctctataatataataaataaataaataaataaataaataaataaaggtctacatacgaatgaaagacaaagattggaagagtggattaagagaacatgacccggccagacacagtggctcaagcctgtaatcccagcactttgggaggtcgaggtgggcggatcacctgaggtcaggagttcaagaccagcctggccaatatggtgaaaccccatctttactaaaaatacaaaaattagccaggcgtggtgacaggcacctgtaatcccagctactcggaaggctgaggcagaagaaacgcttgaacctgggaggcggaggttgcagtgagccaagatcacaccactgcactccagcctgggtgacagagtgagactccatctcaaaaaaaaaaaaaaaaaaaaaagaaaaaaaaaaaaaaaagaaaacatgacccaactatatgctgtctgcaaaaaactctaaatgtaactaggtaggttgaaagtaaaagagtagaaaaagatatgccatgaaaagattaatcaaaggcagtaggagtgtctatattaatatcagataaaatggacttcagagtaaagaaaattaccacagaaagagaatgacattacataatgataaaaagctcactccaccaagaagacatagcaattctaaatgttcataaacaaaatagcacctgcaaaatacgtgaagcaaaatttaacagaactgcaaagagaaactggcaaatccacaactagaactggagacttccataccccactcaaaaactgacagaacaaaatgacagaaaatcaaaaggagtataaaggaaaccaaaaataccatcaaccaacaagatctaatcaatatttataaaacacttcaaacaacagcagaataatcattcttttcaaggccccatgataaaccttatcttggaccataaaatagacctcagaaaactcaaaagaactaaattaacacaaagtatgtcctctgaccacaatggaacccaactagaaatcaacaacagaagtataacaggaaaatctctaaacagaaactaaacaacacacttctaaataattaatatgccaaagaagcaactcaggagaaatctttaaatactttaaatttttatagagaaaatcaatgaaaggttgtttttctttaaaagatcaataaaattgacaaaccttataactgacatagaaaaataaaagattgttattttgttatcaaattattgatatcagtaatatcagtaaaatgttatcaaattattggtatcagtaatgaatcagggaatatcattacaggcctgcaaatatgaaagagataagagaatactaaggacaattctgtacatgtaaatataacaacttaaatgaaattgatcaatacctcaaaaagcgtgaactattacaattcacccaaacagtttaaataggcctataactactaagaaaattgtattaataatcttaaaactcctgaaaaagtaatctccaggcctagattgtttctctagagaattctatcaaaagattaaagaattaacaccagttacacaatctcttgcagaaaatagaaaaggaacactttccaactcattttatgaagccggtataccaagcaaaggcagtaaaaaaaaagttagagatcaatatcttccatgaatatagacattcaagtccttaacaaaatattatcaaaagaattcagcaatatataaaaagaattatacagcacaaacaagcgagatttattctagaaatgcaaggctgtataatccaccagattaacaagctatagaagaaaaatcacatgatgatatcaatcaacacagaaaaattatttgacaaattttaacattcattcattataaaaaagattcacataaaagtagtagtagaggaatacttccttaacttgataaagaacattgacatgaaacctaaagttaacatgattcttaatagagaataactaaatgctttctctctaagatagggaataagataaaaatgtctgctcttactactaatattcaacatagtactggtagatctaaccgctaaaataagacgagaataaaaaagagaagacatacatatgagaaagaagaaataaaaatgttcatatttcaaatgacataatcatttatgaagaaaatttcaaataatctacaaaaaaactcatatctaataagttagttcagcaaggtagcataatacaagatcaatacccaaaataaaagatatttttatatcctaaaaatatatatgtgaaaaccgaaatttcaaacacaatgccatttgcaattattctaaaataaaataaaatacttaggtgtaaatctaacataacatatgcaggacttgtatgctaaaaattacaaaatgctaatgaaatgaatcaaaaaaggcttggacaaatagaaaataagttaaaagatggtagacttaaaccaaagcataccaataattacactaagtgtaaataatgtaaacatcccaattaacaagcagaggatgtcagactggataaaaatgcgagattcaattacaggctatctataagaaacctacttaatataaagatataaataggttagaaataaaaggattaaaaaaggcatgtcatgcaaacattaatcaaaagaaagttggaatggctatattaatattatacaaactaaacatcagaacagagaatattatcagggataaatggagatttacataatgttataagaactattcatcaaaaaaaatcttaaatgtgtatgtatatatctaatgacagaacttcaaaatacatgactcaaaaattgacagaactaaagggagaaattgacatacccacaattatagttggagattttaacacaatttcctcaataattgacagaacaagctgacaaaacactgatagatgtatataagatttgaacaaaactatcaagcaaattatcttatagaacattgtgtggaacaatcacagaatacacattattttgaaacataagcataatatcaccaagatagactacaagctgagccataaaataagtctcagcaaacttcaaaagattaaaatcatgcagaatatattctatgagcctgagtacaatagaactaaaaataagttttgaaagaatctataaaatctctaaaaattttaagttaataaatgccctcctaaatattgtgtaagtcaaataaggaatcatgaaattagaaaacatttcttactaacaacgaaaatacaacatactgaaatttgtaggatatagctaaaataacgcttagagcaaatggataattctaggtgcttatattgttactgacaaaatgttttaaactaattatcttagcttttacattaagagaccaggaaaagggtggtgaattaaaccaaagtaagtaaaaggaaggaaataataaatataaagactgaaaggaataaaataataggtaataatagaagaaattaagtcattcgaaagctggttctttaaaaagatcaataaaattgaaaaattattacttagactgatcaagaaaaaagaggaaaaaactgaaattaccaagattaagaatgaaagaaggaatattactatagatagtataggctaaaaggatatgaaaggaatattgttttgggggggttgtttttttgttttgttttcacttatttgtttattttcaaacagagtctcgccctgtcacccaggcgggagtgcagtagcgtgatctcagctcactacaacctctgcctcttgggttcaaacgattctcatacctcagcctcccgagtagctgggattacaggaacaggcaacaacgccaggctaattttttttatttttaagtagaaacggggattcgccatgttagtcagtctagtctccaattcctggcttcaagtgatctgcccacctcggcctcccaaagtgctggtattacaggcatgagccaccatgccgggccagttttggggtttttttgttttgtttttcaaaaataggttttaagatataccaaataaactatacagatatcctctaacaatacaaaaaaattaaaaatgaggttaaagtatatagcaaaagccaaatatgacaatacacatgaataatttataaaacaaggcttttaatcctaaataactaaaatggggagacctcactgagggctaacatacataaaatgaggactaatagcaaggaacaatcctaaacattttcccatgtgactgactaagccacaaaaagcaccttagaaaaactattagagtaatttttttctactcagttaccaccatcttttccttttcaccttttccctgattttctctaccaatggtttttctttggtttgatcagttgaacccaaaagatttggaacctaaaatgagtatcaactcttattggaatagcgcttgggaaatgcaatcctagaaaaggcaaatttttacctgaggtagcttgagaaagttcagcatccattctcagtgtgagagcatctcccatgttaatcactaggttaatagctgtgcttggctagattacatgaccctgcatgatactggagtgctccctggtgaggtgctactatctacacaaacacctgcccattaagccttcaataaatacaaagcaccattttaaaccatttcactagaataaatttttaaaatatatcatttcttctggcctaacttgcttcttcagatgggctggggtgctgctcatgacacggaagacataacagctaatgtgtggctatttcaagctctttagacttcagcacttcccacttatcaagcctcagtacttttttgcagcaataatggtattttccattaacattccctctgtcatgggaccaacacccccagtaacaggaatgatgtaactggcttttttcctgactccttaaaattccacatctccaaccaacttgagtttgccagttatgggaccttgacctctcttttttcccagatcaatgactgctgaaaaaggggtcaattcagctagaagataaaacaattgtaatataaaattatttttaaaaagaacttccaaaacctagagtaataaatcaatattcaagtacaagaagacgattaaacaccaagcaggtttaacccaaataagaccacctcaaaacatttaataatcaaactcccaaaggataaagatttttgaaaggactctaaaagcaggaagagaaaagaaacaacaaacaatggagctccaatatctccagcagcagacttttcagtggaaaccttagaggccaggagagagtggcatgacatatgtaaaatgctgaaagaaaataacttttatcctaaaatagtatatctagcaaaaatatccttcaaacatgaaagagaaataaagactttctcagacaaacaatagctgagggatttcatcaacaccagacctgtcctgcaagaaatgcaaaggaagttcttcaatctgaaagggggacattaatgagcaataataaatcatctgaatgtacaaaatgcactggaaatagtacacaaacaaacacaatattataaccctataattgtggtgtgtaaactattcatatcttgagtagaaagattaagagataatctatcagaaataataactacaacaactttgcaaaacagacagttaataagctatgaatagaaacaacaaaaagtttaaaagtagggggataaagctaacgtgtagcatttttattagttttctctttgcttattagtttattatttatgaaattagtctgttttaagttatcatcagcttaaaataatgggctgtaagggattatttgccagcctcatggtaaccaaaaatcaaaaaatatataacaaagacacaaaaaagaaaacacataaaattaaaacataccacctgaggaaatcacgtttgccaaaaggaagacagaaagaaaagaaggaaggaaaagaagaccagaaagcaacccaaaacaaatcaaaaaatggcaagagtaagtccttacttacggatagtaacactaaatgtaaatggactaaactctctactcaaaagacatagagtaggtgaacggatttaaaaaacaagacccaacaatctggtgcctacaagaaacacactttgttactgaaacaccagggcttctgtctaggtcctgctgcttgccacagagaaagtcaatcactgagaccatgagtattgccaaggaagaagattttaattgggtgctgcagccaaggagatgagagctcagtctcaaatccatctctctgactgactgaaactaggggtttatatagcaaggaagaaatgtaacaatgtgtaagaaagcaagaattagagaggggcaaggaagcaatcatgacaaatgaagcatctggcatcttattgtctggatgtagtgatctggtgagtttcagttctttaatactttttgtgagaggcctgaaggtcatttcctgaggaaggaactcagacaaaaataaatacaagtttcaagctttaagaccagaaggatcaatttttatgtctatcaaaaaagaactatctatgagactattgggtcagtttcaacttcatctataaggatgcatacacactgacaataaagggatggaaaaagatattcaatgccaatggaaaccaaaaaagatgaggagtcactatagttatatcagacaaaatagatttcaaaacagaaactataagaagagacaaagaaggtcattatataatgattaaaggggtcaattcagcaagaggatataacaattgtaaatatatatgcacccaacactggagtgtgttcggaatttattccttccggtaggttcttggtctccctgacttcaggaatgaagccatggaccttcacagtgagtgttacagttcttaaagatggtgtgtccggagtttgttacttcagatgttcagatgtgtctggagtttcttacttctggtgggttcgtggtcttgctgacttcaggagcgaagccatggacttggtggcgagtgttacagctcttaatggtggtgtggacccaaagagtgagcaacagcaagatttattgtgaagagcaaaagaacaaagtgtccacagtatggaaggggacccgaggaggttgccactgctggctcgggtggccagcttttattcccttatttgtccgcacccacatcctgctgactggtacattttacagagtgctgattggtccattttacagggtgctgattggtgtgtttacaatcctttagctagacacatagtgctgactggtgcatttttacagagtgctgatagtgctaattggtgtgtttacaatcctttagctagacacagagtgctgatcggtgcatttttacagagtgctgattggtgtgtttacaatcctttagctagacacagagtgctgattggtgggtttataatcctctagctaggcagaaaagttctccaagtacccacctgacccagaagcccagctggcttcacctctcaggagcacacagatatataaaacaaatattattacagctaaggagagagatagacctcaatacagtaatagctggagacttcaacaccccactttcagcattggacagatcatccagacagaaaatcaacaaagaaacatcagatttaatctgcactatagaccaaatggacctaatagatatttacagcacatttcctccaatggctgcagaatacgtattcttctcttcagcacatggatcattctcaaggatagaccatatgttagacaacaaaaaagccttaaaacattcaaaaaaattgaaatgatatcaaatatcttctctggctaaaatggaataaaaccacaaatcaataacaaaaggaattctaaagaccatacaaacacatggaaattaaacatgtttctgaatgaccagtgggccaatgaagggcctaagaaggaaattgaggccaggcacagtggctcaagcctgtaattctagcactttgggaggccaaggctggtggatcacctgaggtcaggagttcaagaccagactggccaacatggcaaaaccccatctctacttaaaaataaaaaaattagctggccatggtagcatgcacctgtagccccagctacttgagaggctaaggcaggagaattgcttgaacctgggatgcagaggttgcagtgagctgagactgcgccattgcactccagcctgggcaacagagagagactccatctcaaaaaaaaaaaaagaaaaaagaaagaaattgaaaagtttcttgaacaaatgaaaatagaaacacaacatatcaaaacctgtgggatacagcaaaaggttacaggaataagtgcctacaagaaaaaagtagaaaaacctcaaataaacaacctaataatatgtcttatacaactagaaaagcaaaagcaaaccaaactcaaaattattaggaaaaaaaggaaataataaagatcagagcagaaataagtgaaattgaaacaaaaaatacaaaaaaacaaagaaacaaacagttggttttttaaaaagattaacaaaatagacaaactattagtcaaactaagaaaagggagagaagatccaaataacatcagagatgaaaaaggagacattacaactgatgtcagagaaattcaaaagatcgttagaggctactgtgtgcaattatatgccaataaactggaaaacctagaagaaattgataaatccctaaccacatacaacctaccaagattgaaccaagcataaatccaaaacctgatcagactaataacaagtaatgagataaaacctgtaataaaaattctcccagcaaaggaaaatccaggatgtgatgacttcactgctcgattttaccaaacatttaaagaagaactaataccaattctagttaaactataccaaaatatagaggaggaggaaatacttccacatttattctgtgaagccagtattaccccccagacaaagatatcaaaaatagaagactacagaccaatatccctaatgaacattgatggaaaagtcctcagcaaaatactagcaagccacattcaagaacacaataaagattactcatcatgactaagtgggatttatccctgggatgctagaatggctcaacattatgcaaatcaatgaatagggtacattatgtcaacagaataaaggacaaaaaccatatggtcacttcagttgatgctgaaaagcacttgataaaattcaacatcccttcatgattgataaccctaaaaaaaatgggtatagaagtacatacctcaacacaataaaagccacatgacagacccacagctagtatcataatgagtggggaaaaactgaaagtctttcctctaagatcttgaacccaacaaggatacccactttcaccaatgttatttaacatagtgctggaagtcctagctagagcaatcagacaaaagaaagaaagaaagggcactcaaatcagaaaagaagtcacattatccttgtttatagataatatgatcttatatttggaataacctgaatactgcaccaaaaaactattagaactgatacacaaatacaatcaagtcaaggatacaaaatcaacaaataaaaatcagtagcatttctatatgccatcagtgaacaatcagaaaaagacattaagaaagtaattctattaacaattgctacaaataaaataaaatacctaggaataaacttaaccaaagaaataaaagatctctacagtgaaaactataaaacatgatgcaagacattgaagaggacacaaaaaagtgaaaagatattccatgtttatggattggaagaataaatattgttaaaatatccatactacacaaagcaatctatggctataaggcaatccctatcaaaataccaatgacattgtgcacagaaatggaaaaaataatcttaaaatttacatggaaccacaaaagacctagagtagtcaaagccattctgagcaataagaacaaaactggacgaataacattacttgatttcaagttatattacagaactatagtaaccaaaacagcatggtgctggcataaaaacagacacatagaccaatgaaacaaaatagaaaacccagaaataaatccgtacgtctaccatgaacttatttttgacaaaagtgctgagaacatacatgaggaaagaacaatatcttcaataaatgctgccgggagaactggcagcattccatatgcagaagaatgaaatagacccctatgtatcaccatatacaaaagtcaaatgaaagtggattaaagacttaaatctaagacctcaaactatgaaactacaacaagaaaacattggggaaactctccaagacattagtctggacaaagatttcttgagaaatactccacaagcacaggcaaccaaaagtgaacaaattggatcttgtcacattaaaaagcttcttcacagcaaaggaaacaatcaacaaagtgaagagataacccacagaatgggtgaaaatatttgcaaactactcatctgacaatagaataataaccagaatatataaggagctcaaacaactctattggaaaaaaatctaataatctgattttaaaacaggcaaaagatttgaatacacatttctcaaaagaagacataaaaatggtatatgaaaaggtcttcaatatcactgatcatcagataagtgcaaatcaaaactacaatgagatatcatcttacccaagttaaaatggcatttatccaaaagataggcaataacaaatgctggtgaagaattggagaaaatggaatccttgtacactgttggtgggaatgtaagttagtacaaccactatggagaacagtttggaggttcctcagaaaactgaaaatagaactattatatgattcagcaatccctctgctaagtatatactcaaaggaaagaaaatcaatatattgaagagacatctgcactcccatgtttattgcagcacaattatagctaagatttggaagcaacctaagtgttcatcaacaaatgaattgataaggaaaatgtggtagcaaagagataccatctcacaccagtcagaacagtgattattaaaaagtcaagaaacaacagatgctggcgaggatgtggagaaataggaatgcttttacactgttagtgggaatgtaaattactttaacattgtggaatatggtgtggcaattcctcaaagatcgagaagcagaaataccatttgacccagcaatcccattactgggtatatacccaaagcaatctaaattatcctattataaagatacatgcatgtgtatgttcactgcagcactattcacaacagcaaaaacatgaaatcaacccaaatccccatcaatgatacactggtaaagaaaacgtggtacatataaccatggaatactatgcagccataaaaaaggaatgagatcatgtcctttgcagggacatggatggagctggaagccattatcctcagcaaatgaacccaggaacagaaaaccaaacaccacatgctctcacttataagtggtagctgaacaatagaacacatggacacagggagagtaacaacacacactggggcctgcggggggagtggaaggaggcaggaagagcattagaaaaaaatagctaatgcttgcggagcttaataactaggtgatggcttgataggtgcagcaaatcaccatggcacacgtttacctatgtaacaaacctgcacatcctgcacatgtaccctggaacttaaaataaaaataaaaattaaaagaaaatgtagtgcatatgtacaatcaagtactgttcaaccataaaaaagaatgagatcctgtcattttcaacaacatgaatggaactggagatcattatgttaagtgaaataagccaggcacaggaagacaaacttcacacagtctcacttatttgtaggagctaaaatttaaaacaatgaattcatggaggtagagagtagaatgatggctaccagaggctgggaagggtagttgcagggggtggagagaatggggatggttaatgggtacaaaagtatagttagatagaaaaaataagatattgcatttgatatcacaacagggtgactatagtcaacaataatttattctaaattttaaaataacagagtacaattggactttttgtaacacaaagaaagaataaatgctgaggtattaaatactccattaccttgatgtgatgattacttgttgtatgcctgtatcaaaatatctcatataccccctaaatatatgcatctactatgtacccacaaaaaatttaaaatttttaaaaattaaactcttctggctgggcatggtggctcacacttgttatcccagcactgtgggaggccgaggtggtggatcacttgagctcaagagttcaaaaccagcctgggcaacacggtgaaaccctgtctctataataaatacaaaaattagccaaaggggtggcacatgtctgtggtcccagctgctcaaaaggctgaggcagaaggatcgcttgacactggaaggcggaggttgcagtgagccaagatcatgccactacactccagcctgtgtgaaagagtgagattctgtctcaaaaaaaaaattaaactcttctacttgtcaaaaagcaacattaaaaaatacaaaggcaaaccacagaatggaagaaatgttcacaaaacattgtgacaacaaaagacttgtatccagagtatataaacatctcctaaaactctatgcactgttttgagattataaaatggtaatgttttcttgttattatgaatataataaccttgtaataatcacatgtcatattccaatcacaatttaaataaataaaaaaagaaaaagagaataaagaatcccacgctgcagtatctcctctacatcctcccactgcttctactgaagatctaattgggaaacagagtatccacccttccttttccctggagaggcaaagaaaagtattttcaaagactgagaaagtaaatttaacaaacagaaagataaaattactaatatgagggcaagttgacattcctgaaataataaaaaaaagaagaaattggtacatggtacatattgaagacttctttaaataattggaagtaatttgggcaaaatgagaacaatcaaagaagagacgaaagaatatttatggtgaattaacaattattgaaaaccaatagattagctaaattggtgaaattaaaaatgaactgagcatgccatgtacatcaatgtccaaaagcagccattctctgtggggaaaggtgagtgttggctcttcctagagacaagaggtccttcataattaggttcacaggcactaattttagagtataaaatgcagcttgctgattaacacatgaaacagaattccaggctgaattattatttacatttaaaagcacctttttaaacctcttaaattaaaataaatgtatagtttattaaaatattataagatgatcacccctgcaaaccactacccagatcaagaagtataacttgacaaaacacagaagctgtgtctcaatcacaatcgtgtctcctcctctaaaaataaccactctccttatgtttaagcttccttgaaagttacatcactcaaatatatacccctgataatgatagttttggtttgcttgtttttatttttatgtgtcttttgagtcccttttagtctatacgccacacttctttttattttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccgtttaaccctgagtggacacagcacatgtttcagagagcacagggttgggggcaaggtcacagatcaacaggatcccacggcagaggaatttttcttagtgcagaacaaaatgaaaagtctcccatgtctacttctctccacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggccgaccccccaacctccctcccggacagggcggctggccgggcagaggggctcctcacttcccagtaggggcggctggccgggcaggggggctgacctcccccacctccctcccggacggggcggctggccgggcggggggactgacccccccccacctccctcccggacggggcggctggccgggcggggggccgacctccccacctccctcccggacggggcggctggccgggcagaggggctcctcacttcccagtaggggcggccgggcagaggcgcccctcacctcccagacggggtggctggccgggcggagggctgacccccccacctccctcccggacggggtggctggccaggcggggggctgacccccccacctccctcccggacggggtggctggccgggctgaggggctcctcacttcccagtaggggcggccgggcagaggcgcccctcacctcccggacggggcggctggccgggcggggggccgacccccccacctccctcccggatggggtggctggccgggctgaggggctcctcacttctcagtaggggcggccgggcagaggtgcccctcacctcccggacggggcggctggccgggcgggggggctgaccccccccacctccctcccggacggggcggctggccgggcggggggctgacccccccatctccctcccggacggggtggctggccgggctgaggggctcctcacttcccagtaggggcgaccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggcccgtccgctcctccagccgctgcctcccgggcggcgctcgccggcctatacgccacacttcttatcgccctccttgtctgcaatttatttaagaaactgggtgatttaacccgtgaatttttttacagtttggattccaatgattgcataatcaaaaggtagtttaacatgtttcttgattctctgtggtttctttaaagtagttattggtctaagatgcttaaacttttaatacattgactttagacagcttcaactccatttgcaatagctactatgtgacctctgaatttttggtaggcaagaggtaaagcaattgcagcccagaacatcatgtggagccaggaaatgctgctaggagagagggtggctaagctgacagagttgagggcagttttcctggatcagtttagaggccatgtgcaaaacagaaaccttgcagcaggagggaatgacttatcaaagggaagtggtatctggaagtgtctaggaatggacagaagtcagtacttaacacaggttgactgggaaaatgctgggaagtaaatagagaaaggcaagtataccctgggttccttcaaagcagttcaggaaaatattctctaaatgatggtggttacatgcaacgtaaatgagttgatcaggaatgctccaggtccaccagcatgttaaacttttaatggttgagacgttatataatattttctggtaattcaaagtcttagcaaaactttgtggtaaggatatttgtcccatatttcagataactctaagaatgctaggaaaggggaatatgtcaacaagaaatgttacatgtatggctggatgctattttctattttttccctttccttcagtcaagcatgtggcctggtttatgcttccttacctcacagatatttcagaaagcggaagtatcagacagtaatccctatttatgttctcaaaagccaagcccataggagatttattaataaaagatttgtaaataagtaaaaaaggaaaagagagcttttaataggtggctgaaagggttagaaaaaaaaatgaaggaagaaaggaatttctccaatggtctacatacctttcccgcgcaaaatggaggaacagaaaagatcctgggggtctaagacttgggccagaagttctggaagtgccttgaagagtctataatattttaaaaagggatacatgcatggtgtggctagggacttaggggctaggcatggggttcccaaccttaggacatttcctaagcgtgttacggaagcagtctggggatctgaaagaactgtaggagtgggggacagtaaatatcttaccagggactttctctgtgcatgcaacatctgaaacccctctccccaaccaaacctcaatgccttggccctaaataatcctccagagacttgggggtgtggttggggttagagaaagtctcaagcatgagaagtgagaagcttagaagcagcaattaggttgacacatgttctcacttataaccgggagctaaatattgaataacacatgaacacaaagaagggagcaatagataccagagcctacatgagggtagagggtgagtggagggtgagatttgaaaaactaccttttgggtactatgcttattacctaggtggtgaaataagctgtacaccaaaccctgcaacacacagtttacccatgaaacaaatctgcacttgtaccctcaaaacctaaaataaaagttggaaagaaaaaaaagaaagaacaaaattaagttgacttatttttaataggcttttattacacatcagagtttgtgggatgaaatctgtctccattacccaatgcaaaaatcactgggaaaattagtataacaaatgaccgcaaacacttacatagtacttactatgtattaggcgttgttctcagcttctacgtgtattaacacatttgatcttcacactacttactttagagaaagatgtcattattcctgatttaaagaggaggaaattgaagcaggctaacgttaaagaacatgcttaggattacactgcagctgacaagtggcagggtcagcattcagagtccatgtgggtagtcaccactccaagctttctctccaaaaccgctgactcaggcacactttttaggttaaagtaaatcaggacttatgaagtgaaatgtcagttttctaatggaggaaccagatccaaaatataaaaccctctttaagataatttttaagatgagcaggtgccagctgactcctccttcttgataatgcttaggtgctttggaaactcttcctggatgagaaagagattcttgtccctcttcatctgctgcaaaggacaaagccccagaagaataatatgccaaagtcggccttaacatctatcatccctataacctcatctccctggtgctctgaccttcactgggatggtataaagcagaggctctagagtatccctggaaatgaggagcagcgtacactaaccagtttggtttagagtaattctctcctatttgtaatttttatgaaaaacaatttaaatatggccttggactcatgatattttttatgtcacaataaagtggaaatttaaagttacaaatccccaaaaaggtcctccatcaactcctcataggatgtatccatttttagctctgattattgcagttaactttccaaagtgctgggattacaggtgtgagccaccacgccagcatatttactgtgaaagtttaaaatctgatttgaaagctgcttattataagcaatataattttttctttaacggccccagaatgtttaatgttacataatatgaatatatattttcaaatgtaaaaaaaagcctttttatatataaacatgtataaaagaataaatataaataagaaattaattggggtggcaaagtacatttaaaattttgtgatgtttttgtcaaaaacgatttgaacaaatttataggaaaaaaacaaacaaccccatcaaaaagtgggcgaaggatatgaacagccacttctcaaaagaaaacatttatgcaaccaacaaacatatgaaaaaaagctcatcatcactgtcattagagaaatgcaaatcaaaaccacaatgagataccatttcacgccagttagaatggtgatcattaaaaagccatcattctgagcaaactatcgcaaggacagaaaaccagacaccacatgttctcactcataggtgggaattgaacaatgagaacacctggacacagggcagggaacaccacacacccgggcctgtcgtggggtcgggggacgggggagtgatagcattaggagaaatacctaatgtaaatgacgagttaaaggatgcagcaaaccaacacggcacatgtatacatatgtaacaaacctgcatgttgtgcacctgtaccctagaacttaaagtataataataataataataataataataataataataataaggcaggaagcaacagatgctggaaaggatgtgaagaaataggaatgcttttacactgttggtgggagtgtaaattagatcaaccattgtggaagacagtatggcgattcctcaaggttccagaaccagaaataacatttgactcagcaatcctattactgggtatatacccaaaggattttaaattattctactctaaagacacatggacatgtatgtttattgcagcactattcacaatagcaaagacttggaaccaacccaaatgcccatcagtgatagactggataaagaaaatgtggcacatatacatcatggaatactatgcagccataaaaaaggatgagttcatgtcctttgcagggacatggatgagttggaaaccatattctcaacaaactaacacaggaacagaaaaccaaacaccacatgctctcactcacgagtgggagttgaacaatgagaacacatgggcacagggccgggaacatgacacaccagggcctgttggggggtggagggctaggggagggatggcattaggagaagtacctaatgtagatgattggttgttgggtgcagcaaaccaccatggcacatgtatacctatgtagcaaacctgcaagttctgcacatgtatcccagaacttaaagtataatttaaaaaaaaacagtttgaaaacttccctgaagtaaaaaaagtatcctttgaggaacaatgtaacgatgagctcaagttccacaggaaagagaaaattaaaatttataaagaatttataaatatcaaactattttcatgttttccaggaaaagtgtggctttctcattcattaaccaatagcataatattttccaggaaccttcactcagaagaaatgctgtggcccttccctttaccaacagaaaatggaacacaagagaccacatagctgaacaaattatagcctccttacaagtgagaaaccttcgaggctacatagttttcagccaaaggaaaataaccaacagcttctccacagtgtagactgaaacaagggaaacatgaacatcacaaactgtaccacagaggccagcatggctataagacccaagaccatcactgagaagatgctcatttgcatgactctggtggtcatcaccaccctcaccacgttgctgaacttggctgtgatcatggctattggcaccaccaagaagctccaccagcctgccaactacctaatctgttctctggccgtgacggacctcctggtggcagtgctcgtcatgcccctgagcatcatctacattgtcatggatcgctggaagcttgggtacttcctctgtgaggtgtggctgagtgtggacatgacctgctgcacctgctccatcctccacctctgtgtcattgccctggacaggtactgggccatcaccaatgctattgaatacgccaggaagaggacggccaagagggccgcgctgatgatccttaccgtctggaccatctccattttcatctccatgccccctctgttctggagaagccaccgccgcctaagccctccccctagtcagtgcaccatccagcacgaccatgttatctacaccatttactccacgctgggtgcgttttatatccccttgactttgatactgattctctattaccggatttaccacgcggccaagagcctttaccagaaaaggggatcaagtcggcacttaagcaacagaagcacagatagccagaattcttttgcaagttgtaaacttacacagactttctgtgtgtctgacttctccacctcagaccctaccacagagtttgaaaagttccatgcctccatcaggatcccccccttcgacaatgatctagatcacccaggagaacgtcagcagatctctagcaccagggaacggaaggcagcacgcatcctggggctgattctgggtgcattcattttatcctggctgccatttttcatcaaagagttgattgtgggtctgagcatctacaccgtgtcctcggaagtggccgactttctgacgtggctcggttatgtgaattctctgatcaaccctctgctctatacgagttttaatgaagactttaagctggcttttaaaaagctcattagatgccgagagcatacttagactgtaaaaagctaaaaggcacgactttttccagagcctcatgagtggatgggggtaaggggtgcaacttattaattcttgaacatacttggttcaggagagtttgtaagtatgtgtggtcttgtttccttgtttgtttgtttgttttgttctgttttgtttgaggattgttatttggcgtgctgttttctacctctggtcttatctgtgatacataatttcaaataaacattatcatacaaaaaca

SEQ ID NO: 892 - DNA, 61353 bp, Homo sapiens
cgtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacaggtgagtccccctcgtgggtgcggcccgggtgccacctgcaggccccgccgccccgctgcctgcaaggcccggaagacccctctgtgccgctgggaagtcgcagcttgcggactggggagcgtttcacttgtgcgggttggagttcgggaagccgggagaaacagctctccctggggtggcttcttgggggtgggtggctttgaggggaacctgcgatttatgggaacattgtaaagaaacacgtgacctcggcgatgctcagaagtaggttctgcccctgccacctcgggcagaaggcgggcaggcccgggcgcccctggtggagtcagctggggatcccctcgctagggcaagggcgtgggcatcgcctccctcggtgactttcttccttgcctgatgccacagcaaccggatgggggagggtgagagggacaaaagtttgccacaaagtttggaccaaccaaacacattggtttctttacaaaataaaaaaccagttgtatttttcttctctcccattcaagagcagtggtatctcttgccttctccatccctttgagctccatttttttcttaatcctaaccttttttccccatcccaaattgcttatagagttagcacgacatcagtatgagctggtcaccttccctgacaacgcagacatgtggggcctgggaaatgaaagagcgccttgggacagggggatttggaaatgtcatccgatggcacaatcaggtaggccctctgtgcagcttggggaggggcggggagccaggccccctcctcactgcctccactttctctgatcctgctgggccaagggctcacctttggctttggtcatcttgggacagtgaatagggggactgggaagagggcttcaggacttctgagctgactccaggttagtggtctccatgctttattgactatgtcacctaaataaatagtaaaataaagttaagctcttagtctctattatatatatatggtaacagtagaatatcatgtactaatatatactgatattatatgttataaaacatatagaaataggaaaatttaaaggatgagactaaataaataatttaaaatattttaattccttgaggccagtagttcaagagcagcctgggcaacatagcaagacctcgtctctacaaaaaaggtttaaaaattaggcagccagctgggcgtggtggcttatacctgtaatctcagcactttgggaggctgaggcaggcggatcacgcagtcaggagatggagaccatcctggctaacactgtgaaaccccatctctactaaaaatacaaagaattagccaggcttggtggcacgtgcctgtagtccccagctacttgggaggctgaggcaggagaatcgcttgaacccatgaggcggaggttgcagtgagccaagattgcgctactgcactccagcctgggtaacagagtgagactccgtctcaaaaaaaaaaaaaaaaaaaaaaccttaggcagccttggtgcgtacctgtagtcccactacattggaggctgatgtgggaggattgcttgtccaggagtttgaggctgtagtgagctatgattgtgccactgcactctagcctaggtgacagagtgagaccttgtttcaaaaccattttttaaaaattattttaaatgtcgggtgcagtggcttacacctgtaatcccagcactttgggaggccgaggcaggaggatcacttgaggtcaggagtttgagaccagcctggccaacatggtgaaacctcatctctactaaaaatacaaaattagctggtgtggtggtgcatgcctgtaacttcagctactcaggaggctgaggcaggagaatcgcttgaacccaggaggcagaggttgcagtgagccgagatagtgtcactgcattccagcctgggtgacagaatgagaccctgtctcaaaaaatatatatatatatatatatttaaaatatttgctaattatgatgtcttcccagtattgcttgcgatactgcacggcaaaaaataagcagatccacatgaaagtgagaattcatttagaatgatgatgaaaatccatatttcaaataattaacatttttttaaattttgtagagatggggtcttgctatgttgcccaggcttgtctcaaactctcatcctcaagcagtcttcccgtctttgcctcccaaaatgtttggattacaggcctgagccatgggacctggcctcagctgaggttttttttttattttttgtagtgatggtggtctcacaatgttgtccaggctcgtctagaactcttggcctcaagtgatcttcctgccttggcctctcaaagtgctgggattacagccatgagtcattgaacctggcctgtttttatttttaattgacacataataattgtacatatttatggggtacagtgtgatattttgatacataatgtgtaatgatcaaatcggggtaattggcgtgttcatcacttgaaacacgtatcctttttgttggaaacagtcaaaattctttcttctggctattttgaaatatacaatatttttttttttccggagacagagtctcgcactgttgcccaggctggagtgcagtggtgtgatcttggctcactgcaacctccgcctcttgagttcaagtgattctcctgcctcagcctcctgagtacctggaattacaggtgtgcaccaccatgccagctaatttttgtatttttagtagaaatggggtttcaccatgtaggccatgccggtctcaaactcctgacctcaggtgatctgcccacctcagccacccaaagtgcttggattacaagcgtgagccactacgtccggcctgaaatatacaataaagttttattcactgtagtcaccctgttgttctttagaatactgtaacttattccacctaaccgtaattttgtacccattaaccagtctctccctatttccctccacaactccccccacccccaccaccctttcctgcctctggtgaccactattctactttctacttctgcgagattagtttgttgttgttgttgttgttgttttgagacggagttttgctcttgtcgcccaggctggagtgcagtggcgcgatcttggctcactgcaacctctgcctcccaggttcaagtgattctcctgccccagcctcccgagttgctgagattacaggtgcctgccaccacacctggctaatttttgtatttttaatagagacggggtttcaccatgttggccaggctggtctcgaactcctgaacttaggtgatccccgccggcgcgcccccccccccccccgccatcccagcctcccaaagtgctgggattacaggtgggaactaccgagcctggacgagatcagtttttttttgtttgtttgttttgttttttgagatggattcttgctctgttgcccaagctggagtgcagtggcacaatcttggctcgctgcaactggtgtctcccaggttcaagcgattctccagcctcagcctcccaagtagctgggattatagccgtgcaccaccacgcctggctaatttttgtatttttagtagagacagggttttaccatgttggccagtctggtctcaaactcctgacttcaggcgatctgcctgcctcggcctcccaaagtactgggattacaggcatgagccactgtgcctggcatttttttttttttaatttttaatttctttggagatagggtctcaatctgtcatccaggctgagtgcagtggtgccatcatggctcactgtagccttgacctcctgggctcaaatgatccttctgcctcggcctcctgagtagctgggactacaggtgtgcgttgccatgcccggctaatttttgattttttgtagataggaggtctgtctgttgcccaggctggtctcgaattcctggacacaagtgatcctcccacctcagcctctcaaagtgctgggattacaggtgtcagccaacagactttacccaactgagatcagttttttattagctcccacggatgagtgagaacatgtggtatttatctccctgggcctggcttaattcccttaatgtaatgccctccaagctcatccatgttgccacagatggcaggatttcattcttttttatggctgaataagagtacattgtgtctgtgtaccacattttctttgttcatttgttcattgatggacatttaggttgattacatattttggctattgtgaatagtgctgcagtaaacgtgagggtgcccatatctctttgataaactgatttcctttcctttggatagatacccagtagtgggattgctggatcatatggtagttctatttatagtttttcttttttttttgagacggagtcttgctctgtcaaccaggctggagtgcagtggcatgatctcagctcactgcaacctccgcctcccgggatcaagcagttctcctgcttcagcctccaagtagctgggattacaggtacatgccaccatacccggctaatttttatgttttcagcagagacggggttttaccatgttggtcaggatggtctcgaattcctgacctcaggtgatccgcctgcctcagcctcccaacctgctgaaattacaggtgtgagccactgcgctagccttgtttgtagtttctcaaggaacctccatactattttccataatggctgtgctaatttacattcccaccaatagtgtatagagttccgctttctccacatccttgccttcatttgttactttttgtctttctgataatagccattttaactgtggtgagatgatatctcattgtggttttgatttgcatttgtctgatgattagtgatattgaacattttatcatatacttgttggccatctgtatgtctgagaaattcctgttcaaatcatttgcccatttgaaaaattggattatttatttttttgctgttgaattgtttgagttccttgcatattcttgatattaatcccttgttggatggatagtttgcaaataatttctcccattccataagttgtctccataggttccataggtttattctgttttttcttttgctgtgcagaagctttttagtttgatgtaatctcatttgtctacttttgcctctgttaactgtacttttgaggtcttatccataaaatcttttcccagaccaatgccctgaagcacttcccgtatgttttcttgtttttttttttttgagacagtctcactctcagctgagacaggtgcgatctcgggtcactgcagcctctatctcctgggttcaagcgattctcctgcctcagcctcctgagtagctgggattacaggcagcgccatcacacccggctaattttttttttttttttttttttttgagacggggtctcgctctgtcgcccaagctggagtgcagtggtgtgatctcgggtcactgcaagctccgcctcccgggttcatgccattctcctgcctcagcctcccaagtagctgggactgctggcgcctgccaccacccccgactaattttttttttgtatttttagtagagatggggtttcactgtgttagccaggacggtctcaatctcctgaccttgtgatccgcctgctcggcctcccaaagtgctgggattacaggcgtgagccaccgcacccggccacgtgtggctaattttttttttttttttttttgcaacggagtcacgctctgttgcccaggctggagtgcagtggcttgatctcggctcactgcaacctctgcctcctgtgttcaagcgattctcctgtctcagcttcccaagtagctgggattacaggcacctgccaccatgcctggctagtttttatatttttagtagacacggggtttcaccatgctggccaggctgttctcaagctcttgacctcaagtgatctgcccaccttggcctcccaaagtgttgggattacaggcatgagtcactaacaggcgcctggcctgttatttatttttaaaaagccaaaagccagcttcctcctcctgccggctgaaccccacacagtctgtctgcacctgcctctccatcattcctccccttggctgcctctgttttgagcgctgagccctcttgccggacaggcctccccctcctccacattcctccaggaccaactctaggccatctcctcctcatatgcgtctgggatggctttgttctgtggcaactggttctcccggtgagttcctctgggctggttcctgtgccgcccttcctgtctgcgtgtggagtaagtcttgtcaggaccctgcattcctggtcagccagggctgggtctggcctttggagttccttcagttctcctgtagcaagtgcctgacgttgtatatgtgctaggtgccccaaatcatccactctgccagtccacaaatatttatcgaatgtctattatgtgtacattggtaattaaagcagacctttggagaagggaaggagccattagtcaactaattataaatgtaagctcctaagtatggtaaagtgtgagttgggagaaggacccagtgcactgagaccttccgttggggtgggatcagtcagtgtcagaggaggttccccaaggaagtgacacttgaactgaggccctagtagaagtcagcttgacagagaaggtgggaggagagttccaggccaagggagaggctcctgaggggcctctgtggagggcaggtgtggcaagtgggcaagactgaaggccagcgtggccggaagggaggatggggcacaagtgcctgggtggctgagggtggacggtgcaagtcagatcctgtggtgttttttgggcagtttcagccgaggaggttttgttttgatggaggagcagtggaacgatgttagagggaggcgctgtgcccatggggacagattgggagggcccaagcagtgggcagcgtgctgggaaaaaatcagctctcggaagaaatgccttgatccatagtgtgcagcagttctcatggagtagctactcccaccagggctgacttcaagccaccagtagtttaatagcccgctccggcctgattcctgagtagttaacaaccagctctcagtgactgctactacagtgtcactggctccgtcccagtgatgcaggcagaccaggtctgaatgttttggagtcgtctaggtgagagatggggagaggtgggcagacttaagagatatttagcctggtgcagtggctcatgcctgtaatcccagcactttgggagcagaggcaggtggatcacctgaggttgggagttcgagaccagcctgaccaacgtggagaaaccccgtctctactaaaaatacaaaattagccaggcatggtggcgcatgcctgtaataccaactactcaggaggctgaggcaggagaattacttgaacccaggaggtggaggttgcagtgagtcgagatcgtgctactgcactccagcctgggcaacaagagcgaaactctgtctgagaaaaaaaaaaagagagagagagatttaaggggtggaattaacagcgcttagtggtggagtagaggtggaggggagcaggaggagtggagtgcctgcaggtcctcaatgatgcctacccgtgagcccggcccaggccaggaagctctctaccttccttccccgtgggttctccccaagtttgggaaatctctagggctgctttgggtgctgaggagaagtctttgatcattgtccaagttcagaagatgagcgtgtatgttctctgttgggaacccctctgttcacagcctcttaaaagaagcagctgggctatggtggtgttggttccttgactctgatggttttactccacgtaacaacagtgtgcactttcctgacactccatgcactgcatcttgtctgcagaagaaggaatgttgtagttatcacaatagaagttacatgaaaaagcccctaagcatgggtatcctcagtcagagaagtggcctgataatcagaggcatcatttactgagaacctgctatgcgccagcatcaaactaggtatttacgtgctttctctccagccctcacaactctgaaaggaagtactgttgtctttgttcccattttatagttgaggagactgaagcacagtctctgtgactcacccacagacctgagctcgcaagcaaagaggctaggattggaacctgcgtctgttcggaacccaacctcatgctttttccattgtgcctgtggcttctctgtggtgaggactcagggggaggccttggtgttccttaggctctcattgttcaccacagtctaaacctttttgaagcaggaaggggaaaacacttctttattgattttttgttgtttgttttttgagacagggtctccctctgtcacccagactggagtgcagtggctcgatcagggctcactgtagccttgaactcccaggctcaaggagtcctcccacttcagcctcctgagtagctgggactacaggcgtgagacaccacgcctggctaatttttttatttttgtagagatgaggtctttctatgttgcccaggctggtctggaactcctgggctcaagcagtcctcctgccttggcctcccaaagtgctgggatttcaggcatgagccactgtgcttggttgaaaaacacttctttggaggacaaaacacttataagtcttccttgttagacagagaaccccacattgagtgtttcccagggagggagggcagtgaacaagcgagccccaccacaacctgcttcccctgttcttgtggttctcctgccacgcgggcctcaccattccacattgtgtcgggactccctaagacctccagcccaggggtcagcacaaaccacttcccagtaccgtttagataggctgatattttcaatgagacctttgttaaatacaaaggaagaggaggaggagataaccgagtgctcccacctggcagcatgttttgggagtgggggcgggaaacacgatactcagtcacacagacctgggttcagatcctggctctgtcagcgtcttggctgtgggtccccactttttgcatggattatggggattctccaatactgatctcctcagtgctgggtccccaacatggctgggcaggatgtgggtcagctaccttctggaagccacccagggtaccttgtgatatcatcatgttctgtgtacacttggctgtgaggagggccaggaagcgctgcctggggccctgcgggatgctcgttggggtggaggaggcagtgtgtgtactggctgttagaaggcagagtattaacgatcccttctatgaagcagcacggacctgtacttgtccctttatgggacaaggcaaagctttccacagcttatctgtgtgcttggaagccttaaagcctctgctccgttcagtcacttctctagggatttatagagcctgggcccgagctctgtcagggataccaggaaaaaagggtccctgcccttcgtgtgcttactctctgatcacagtgatccagggagcattcagaaatgcattaagtgagtctaaatccaagcaccgaactgcatggataacagtggctgccatttttccagggcatcatgtggcatctgagctgggttccctgtccgcatgatctctcccgaacgctggggaagggaggcttcttggggtgaatggagctttagcaggatctggaaaggaggtacactttcgagggcctggcaagaagacagaagccgactcaggtgggcagagcagcatctccacagggccagaaaaggaagtgaggctgcggtcgtttattcccggctccctgtggtcggatgctgtgtttcattttagctgacatccctggagtggatggagccatccccatcttatggatgaggacccagatgcttgtaccatgggcttctatcgcacctttaccaggcggtgggggagggagttacacctggacctgcttgtctcctgagcccgagtgcctggcttctgtgggtgaggcggcaggccactgtgccccttgggggtctgcactgtagggagtagggtgaagaagtcatggccctcttagcgtagaccaggcgatgctggggcccagggtctgtccagttacctgctgagccaggggtgaaactgcagctggatcccggacctttttggctcccagccctgggtcctcctgcccagtctctctggtcccagccctgcacctcctttctgaagcattcatttcagggggtggggtctgagaaggaggaggaggtttttactaattgcccccatgtccacagtggcctggttggatgcttgccatgataacgggacactgggctttctgcgctaagggtctaaacatggctcttggcctctgtgagtttcccctgagtcgctggaagaggcaaacttgaggaagctgggccccttttgtttctcctgtgactgggtcttcagctcgcatctgccaggcaccttttggtctgaggatgtgctccccctctgccttttttacaccttatgacacacatgcttatatataagttttatgtttacatgcatcaaaggcaaggaattgcaaactctgaggaccttcataatcactacattcaatctggacatacaggggaccctttctccgttttctcaaaatacagaccagttttttgttgttttgtgtgtgtttattttttgagacagggtctcactccagtagtccacgctggagtgcagcagcatgatcacagctcaacgcaggtctcgctctattgcccagccttgacttccgagggtcaggagattctcccacctcagcctcccaagtagctgggactacaggcatctactactatgcctggctagtttttaaaaatatttttagtagagacagagtcttgccatattgcccaggctggtctcaaacccccgggctctagcgatctacctgccttggtctcccaaagtgctgggattataggtgtgagccaccatgcccagccacaaagcagttttaagttttgtccttcacgaggagttcatataccagaagttgggtactgagatggcgcaggcctagtctgggtttccacagaactaagctaagactcagtagattccaggaaaaataaagtaagccatccttcttaccttacatgtgtttgagttccactgctagtgaagaacaaactccctggggtttcagaaccggtgatcgtagcctgcttctgttttaattgaattttgctttctagagcaggtatgtttttagtaacaaagtcattctgtttgcatttctgtttcaaatgaaacattactcatggaaaaactgggaatatttcggaatacttcctagaggcagatgaaggccactgtgttaggaaaagtttaagtatgtctgtatctacgcagaccttcctaggcccagggagttaggatttcgcctcaactctagggcgaagctgagctgtctgtgagtagaaagttagttttggtatctatgcccagttatttcaagacttgttcagtgttcacattgctgagttcagtctttttagtttgcatttggatatttaagaccaatatcaagtcttcagtatcagaatctcctcctgattctgggttgggccaagtgacagctgtgtatcaggtccagtgtttgtgttgggcaaaagactgcaattatccaatttgtagctagacagattacctaaaatcacttaataaactaagtcatctaatctattttttggatctgatgatctgtcctgtttcatttatgataggtagaataatcccccccaaccccaccaagaaatctggatcctaatccctgaacctatgactgggtggggcagcatggcaaagggaaattaaggttgcagatgaaattaagttttctaatcagctgaccttagagattggcctggcttccctgggggtcccagtgtaatcccaagggttcttaaacgtgggagaaggaggcagcagagccagggtcagccgatgcatgtgaggaagatggcgggacatggctgacacacggatgggctaaggggctacgagctgaagaaagtggcgcttctagaagatgcagaaggaaaagtagggaaacagactctcccctagagcctctggatggagcatagccccaccaacatcttagctcagggagacccacatcaggcttcagcagatagaactgcaaggaaataaagtgtgttattttaagccaccaagtttgtggtaatttattacggcagcaatagaaaacaagtgccctcttctgtgtattgaagttacgttgctgcagatttttcagtatcttggtttagtctcagtcattctaaggtaacgaaccataagttacagtctctttggctaaaccattgcttggaatagtgtccatggaaatgttgcagggtggatggaggtggatagatgctcttggcaatggcacctcacgctgcagcggggccatcggtctctgtttgtggaaccctgcgttccccacgtctgagctcctctgcaaactccgcctaactggaggcaagtgtctgtagcagtgtctcagtcggctcagtgctgctatcacagagtagctgagaatgggtaatttataatgattttatttctcatagtcctagaggctatgaagtccaaggtcaaggcatcatcatagggtgaaggcgaaagggcaagagacaaaagggaccaaacttgtccttttataaccatcagtcccacctgggatgcagagccattgtggccgaattgccccttaatactgaggtgatgtcctggcgcagtggctcacacctgtaatcccagcactttgggaggccgagacgggtggatcacgaggtcaggagatggagaccatcgtggctaacatggtgaaaccccatctctactaaaaatacaaaaaattagccgggcgtggtgatgggtgcctgtagtcccagctactagggaggctgaggcaggagaatggcgtgaacccgggaggcggagcttgcagtgagccgaggtcgtgccactgcactccagcctgggcaacaaagcgagactccgtctcaaaaaaaaaaaaaaaataccgaggtgatactgctacaacaggaattggctttcattgaattatggaaaactgtggaacttaagccatagcagatatcgtcaggcagagctgctgtggatgaagctaccacagaactgggcaaaaatgtgtctgagcactgtggggaagtgaaacctgaaagcaaattcacgtcagcctgagaacagaccaggaatcgggaggtacagggaggtgtaacatggtctgcacatcaattaaagaaacgttattcttttttttttttttttttttttgagacagagtctcactctgtcacccaggctggagtgcagtggcacgatctcggttcactgcaacctctgacaccagggttcaagcgattctcctgcctcagtctcccgagtagctaggattacaggcacccaccattgcacccagctaattttttatttttagtagagatggggtttcaccatgttggccaggctggtctcgaactcctgacctcaggtgatccacctgcctgggcctcccaaagtgctgggattacaggcatgagccaccgtggctggccagaaatgttattcttttgacacattccctaattcttgaaaagcttgagatggacttgtgtccaccatggtttgtaccactgtactaatcagtttaatagcaacaaggtggccgggtgcaggggcttaggcctgtaatcccagtgcttagagaggctgaggtaggaggaccacttgaggccaggagtttgagaccagcctgggcaacatagtgagactccgtctctacaaaaataaaataaaaataaaaaaaattagctggacacaatgacacatgcttgtaatcccagctacttgaagctgaggtgggaggatcgcttgagcccaggagttttaggcagcagtgagctatgatcactccactgcactgcagcctgggcaacagagtgagaccctgtctctaaaaagaaaaaatagcaacaggttttacaattgttgagagaggtcagctcttgttcagagagcgcctcagaatctaggccaaagatcagggttctactagacaaagagaatgagaaggatacttagggcagaacctggatgcccatgcctactgccgcagactggactgagggggtctcccatagtcacagacgtaagcctgtggctgcaccatgggtgagccttggaaacagtgctcagggaaagaagcctgtcacaaaaggccacatgatatatgattccatttatatgaaatgtccaggacaggctaatccgtagagacagaaagaggtgggtggttgcctaggactagaggggctcggggagtagggagtggctgctgatgggtgtggagttttgttgtgggatggcagacatgttctaaagtgtgccgtggttttggtctcacaactcttgagtatgccagaaactattgaactgtgtaatttaattggatgaattgtatggtgcatgaattattctcaatagagctgttaaaaaaaagtaggcatgcaaggtcaccatctgatggaaagcttagccaaagtggtattgggctttgatgaaagcagcttctgagagtattttagaagtgttgacagtacctcctttctggcatggagtctgctgttccatttccacctttttttctgaagcttttggttcttggtgtcggtgttaaggattggtttattggtcagtgactcagtggtcttattagacagcttctggtgtatgtggaggtttccatttttccttttcttgctgtgaaggtccttgttcctgcagggatcctggccagtttggtaactgtgagactgaggtggcttgagtgccatgggaacagccacactgggaggccttgccacagtcctctgtgtgtctttttttgtttttgtttttgtttttgttttgaaacagggtcttactctgttgcccagatctcctgcaacctctgcctcttgggcttaagcaatcctcccacctcagcctcctgagtggctaagactacaggtgcatggcaccacacctggctaatttatgcatttttttgtagagatggggttttgccacgttgcccaggctgatctgtgtgtctttttaagtcccattcagtaccatgtctgttgctcacttacaagatttatgattcttttcagtttgcatcttcataaactgagaaaacagaaattggcctaacagggcctctaggacatccttcaagtgagccacagtagagtctggtacaatgctgaaatcttctcctactgctgggtgccctgtgccaccctgcaggtgtggctcttgcccaggtgtgtgtgcgggtagggagtttcgtgctgtaggtacacaggaggtgcaggatgttggtgcaggtcagcttgtttagcagtggcaggatcggctctcaggctggggctccgggagctgctgccttgggcagctgctgccccgcagttgtcttggagacccccccatagccaaaagaggtgacagtggtgcagtggtgactcccttgtggcagctggagtgcccgaggccagagccgctttccctgctgcccgtgccacagcctcagggcctgcccgtctccagtgtccccactcatgcaccagggagaagaggggaggccgccaggagccagtggctcagctcatgattcaccaggtggaggagccaccgctgaggatgctgctggttacctcgatagaggttaaagcccatgaagatggacaagtctataatttaacaaagagaagagaaaacagcctgttactctgcagaaagtaactctttggcatgtgcactgaaggaattacctgttacaggagtatagcagagggtgagaccctcttgagctcggcagaccgtggtgcccatgcacctgtgctggcaagtgtagcagagcagggccaagcgccagggtgggtggggccgtctggctgtagtgtcgtgggaagagtggctggaaatgcagataggagccaatctctgtaggatgttaaacaggagtactcggatgacctgggttccctgctctgcagggttactaatacctgctagaggcttgttttcaagccctgaaagatgggtgtcagtattcccattttacagaagaaactgagtcagaccaagtggtttacccaaggtcacacagctagtaaatggcacagttggaatttgaaccagccagtgtttcatctgctatattatgccatattatgcttgcgttctctctgaaaggacaaaactctcacatgaaacaatgaagacactcaatgtggtgttcactattaggttgaaccacatgcaggtgccatttttgtaggtcaatgtggtcaattatcagcagtgtcccatgggtcagcctaatacagcagcagccggggttcggacagggaaacctctctgcgcaggaatggtcagtagaggtttcatggcggagctgggaatggagcagggccttgaaggctctgtagactctggatggatagaaatgaggtgggagaggctgggtgcggtggctcacgtctgtaatcccagcacattgagagtgcgaggcgggcagatcacttgaggtcaggaattcaagactagcctcaccaacatggtgaaaccccgtctctactaaaaatacaaaaatttgccaggtgtggttgcgcatgcctgtaatcccagctactcaggaggctgaggcacaagaatcacttgaacacgggaggtggagtttgcagtgagctgagattgtgccagtgcacttcagcttgggcgacagagcaagactccatctcaaacaaaaaaaaaaaaagagagagaaagaaatgaggctggagaggttgggtgagaggtggagtggtaaggagacagcccaaagggcaggtgctacgtggctgtcgatcagggtgtacatgtgaccttggagcaccaggaggtgattgcaggtaacgcttggggcctggagacccctcccatgcagcagacagggtgggatttggcctgcagctcgctctgctggtccccactgtgctgtttctgtaggaaacaggtgagcagattgccatcaagcagtgccggcaggagctcagcccccggaaccgagagcggtggtgcctggagatccagatcatgagaaggtgagggcctcgcgcatagggacccaagggaaagctggagcagcagcccccggtgtgtctagaaaggagagtcttgctgggtgcgtggctcacgcctgtaatcctagcactttggaaggccaaggcgggcagatcacgaggtcaggagactgagaccatcctggctaacatggtgaaaccccgtctctactaaaaatacaaaaaattagccgggcatgggtgggcgcctgtagtcccagctacagagaacaccagggaagggggaagggcatgctgcacactctgctgggattactccaatgacaaggaaaccccgtctctactaaaaatacaaaaaattagccgggcatggtggcgggcgctgtagtctcagccgctcgggtggctgaggcaggagaatggcgtgaacccaggaggcggagcttgcagtgagccgagatcaagccactgcactccagcctgggcaacagagcgagactccgtctaaaaaaaagagaagagagtcttaaatatctgcccctccatcagggcgccagcctggcagtctccacggtgactctgctgcttctaaagacaccagaggaagagcagctaaagtccacactgggccttgtcaagggctgttcatcaatttcattgtattaaataagttaacacagttatcacagtgacttttcttttgtcagcaaaaaaagccttctttcctcctatatttccagttccaaggtggtatgtgaccgttctctgctgtcatgctgtcgctgacatttattcctctagtgtggagacggggctgtccatctgcctggtggctgctgaccccctagctagtgaggcgtgaggtgggctccgaaagagccagtgaggaggacaccaagcaggggctcctctgccagcctcttaaaaagaggaggtgctatttggttatgtcatggttccatttggttacatgagttccttctcagacccttctctgtgtgtccaccttggggtgatgtgtgtgcgtgaaccaacctgccgaaaattaaacagacaaaagaaaaaaaatatgaaaacaaaaagagcaggcaccaccttgtttgcctgcttgcgtgtgtgacacatcctccccatgtggagggcatgagattgaaaggtccttgtaggagcagtttggcagcacgatgaggacttgggatgtggcacgcacaaaaaactgaagttacacgcagttgtgccctcagggtctgagttctggtgctgtgagtggggctgggtgagcgccactgacccaggcattgcggttggccacccgtcctgggctctgtcttcctctgtttcaaagccctgggttatcctgggcctttgttgctgagacctggtgggggtggtggggatgggtctgggcaggagcctgggtctgctctcatcggttttcctcctcctaggctgacccaccccaatgtggtggctgcccgagatgtccctgaggggatgcagaacttggcgcccaatgacctgcccctgctggccatggagtactgccaaggaggagatctccggaaggtgaggctcccacggctgccaggtgcacagcctgtctgggcaggtgggacaccaggaagagggatggggagacctttcacttctgtcatcatcaggaagcttggggagccccagtgactccagcagggctgctttgcctctcagatcctctgttccctgcccacctggggctggtgtgtgtgtgagtcagaggcgcttccgagaacaccagggaaggggtaagggcgtgctgcacactctgctgggattactccaatgacaaggaaaactcatcacaggtctgggcgtggggaaggactgggcaagttccaaaacaaatgcttcctccctgggcatgttagggccacgttaggcctttggtgccagtgccactgctctccttattaggagggattttattctagagatgggacagcaccacacacgggggcagggagcatagcagagagggagcaggattcatgatcagagagccgggccagggctgcagacccgccccaatccatccgatccacctgacccacctggactcatctgtggggctctattctccaccttctcaccacaccacctcctcttccctagaatgttcacttctggtgggtggatggcagcccctcctggtctcaggggcagttgggtgccctcctccccattgttccctatgacagtaccacacagcctgctagtacatgttacctcattcgatttccaaaagctcacacatgggtgcacaggtatggttcccacatgatgggtggatgtcatggcccagagaggttgggcctcacacagctgtagcagcagagcctgggtcccagcccacacagacccagctgcaggccacctctccatctctgaggctgaataaggccatataacattatgaaaactggaagctctgaacaaaataatttttttttttgagacaagagtctcgctgtattgcccaggctggagtgcagtggcgtgatctcggctcactgtaacctccatctcctgggtccacgtgattctcctgcctcaccctcccgagtagctgggattataggcgcccgcccccacgcctggctaatttttgtatttttagtagaggcagggtttcgccacatcagccaggctggtctccaactcctgacttcaaatgatcacccacctcaggctcccaaagtgctgggattacaggtgtgagccactgcgcccagccaacaacaatttttattttaattgaaaaagaggtcggttgctctgcgagtgcacctcttcactccagaagggtcacaatagtgggggcgggagcccaggcgtttattcctgttcagtggccattcccagacacacttcaggtgctgttctcactgttcctccaggcccttgtgcctcttaaaaaaaaatttttttttccactttggaaagctgagacaggagaatagcttgaggccaggagtttgagaccagcctgggcaacataccaaggccctgtctcctcaaaaaataaaaaatgaaaaattagccagatgtggtggtgtgcgcttgtggtccctactactttggaggctggggtgggaggatggcttaagcctgggaggttgaggctacggtgagctatgattgtgccactgcatgccagcctgggtgacagagcaagactcagtctcaagaaaaaagataatcctgtctcagaacaaagagacagataaataaaataaaagaaactttccatggggcttggcgtgctggagtggctctccctggagataggcatgtcctgggagtggcactcacagcaggatatgaacacagcccttggcatcacccacaatgagagatgggggaactcaacagcacttcgattttctccttatttttctaacctttgacagtcacccattactaactgcagctgtgtagagataaagccatgttgtagtcaagtggagacttctcagagggcagtctggaagtaggtgggatgtggccagattacagagggctctgaagtgaggcagaggcttttagacttggtcttttaggtggcaaagagccaacgagccagggaagaagagatcgaaagtttaacatgactggcctggcgtgggttgcaggatgattgagggggaggcaggaagggctcgcatcctaagggacccctgtccttgctgtcacccagcggggttgggggaggacactgttgcccagtgtcttgttatgtgttgtttcctttgttccctctaaaaagttcaaatctataatacacccgtgggcatggagaggcaggcttggccagcacatggggacatgtaagagtcgatgttaaaagtctacatgctgggtacgtaaacagatgagtgtttatgaatatgacgtgaattccaatggtgaggctcagatgggaagctcctctctccgccctcctcggaggccagctcccagcagcacacagagcctcttgacagtcgagggggccaggaaggcaggggattaagggcttgggcttgagtttcagattgacctggcgccgcattccagcactgccctctcacagctgtgtgagctgacaggtatccgaccgtgtaacctcagtttcctcctccaacacggggattccacccgtacttactcagtggtggtggttagtattaaatgaggtcacgcagggaaggctttgctgagctaatctgtgcagagctcttccggcccctggcacgtagtaagtgctcagtaactgttctctactgttaccatcacccacatggctaggagatggcagggcggtggtcggagggtggtatccagtcatgccctcccagcctggcccgtctctaggactctcatgcacagagaattcctatttcctgtgcttagacttcagcctgccttgctcagaactgcagcagctggtgagaatcaaactttactcacctcagaggccccttgctgtgaggatgtgagagccctggggtggtcaggactgcttcctctttctcctcctcctcctcctccggccaatccctgctagttctgcagccctggcttcctcaaaagcaggtcccctaaagaccagggcccagggtcagcactctggtcacatgggctggtaagagacatgtgtggatttccggtggtttgtgaccaccagctctgatgctgcttttcactttcttgacagtacctgaaccagtttgagaactgctgtggtctgcgggaaggtgccatcctcaccttgctgagtgacattggtaaatcccagtcccggaattcaggccgtgtccttcagggagagtgtggtgcccctgtgagtccctgcggagccctgcaggcagacacttcaatcctttggtctctgtggaaggggaatgggagcccagggacgggggaccctggtggagtagggaggtcaacaaggagtcagccagacagatgctgaactcaaataggtttcccttccttcctgattaactcatcaggtgaattatgatgtatagggaataacagatttcctttcccattataaagctcccctccctcctttcctggaatggccggcgctggaataagttgtcattcgaatgagttttgtcccttggcagtgaatttttccgctcccacgtaggcagttctttgccaatgagaggcgtaggaaaaactgtcctttttaatcccttgggtactgttggcttccccaaatgagggcatctgcggcaccctctgagaaggccaagctggccattcatggagaagagtgacctcagcctgcagaggtcagtggagcctcctagaccctggcgctcactcaggaggggtctgagggctgggcgctaaaggtcagcacctggccccagcctggggagacagggagagggacttgctcagagctttttgttttttttaaaaaataatctccagggttgttggtgcaagttgatagttggggtctaaggtttagagttatcagaatttatctttgactctttgcctccagatttggagaatgatgccattttcatccctccactacctcaacctttcaaagctgtatacattttttctttttgtttgctcaagtttttttggaaaattgtcaaatatatagaaaagttaaaagagtagtacagcaaaactcacataccgttcccctcggttcaccagatgttaacattctccctcatttgtaaagctgtcttctctaagccagggcctggaagggttgatggtccaacactgtcttgctagtgtgggtctggtctcttcctgactgctgcttttgacagaggagaagcaagaaggaaaggaaggggaaaagtcaagcaatgacatatttaaggttaagatccaaatagtctgacacagaaaattcccatcttgctctgtgctgtgtcttcgtccctttgggtggagttcacatggaggatacgttgacattacatcagttttatttgactcgaatgagcacccagtgctggcccaagggatcccctgcacatggcccgcatgagtctcttctctgtctacctagagcataatccatcagttagaaattccacttgttttcttgacaccctgacccaaggctcacccatccatgttttgcttggaggcttacttgattgtattttttacctcagtggccagattcttcatttgttctctgttgaattgggttgaaggcaggttagcaggttggggagtattctcttgcttttcttgggtgatttttattttgtttctctttggttaaagctttgtcaagttattattttttttttggatgtttttctctcagatatttttctttcactccttaggctgttgatgactttagcaagtagttattacgaaagtcttttttttttttttttttttgagatgatggcttactctgttgcccaggctggtgttgcagtaggcgacctcagctcactgcaacctctgcctcctgggtccaagcgattctcctccatgagcctcctgagtagctgggattacaggagcacaccaccacacctggctaattgttgtatttttagtagagacagggtttcatcatgttggccaggatggtctcgaactcttgacctcaagtgatctgcccatctcagcttcccaaagtgccgagattacaggcatgagccacagcacctggccaaaagtctttaaattattggcacaagtgccgggcgcagtggctcacgcctgcaatcccagcactttggggggctgatgcgggtggatcacaaggtcaggagttcaagaccagcctgaccgagatgctgaaaccccatctctaccaaaaacacaaaaattagctgggcatggtgacgggcgcctgtaatcccagctactcgggaggctgaggcagaaaactgcttgaacccaggaggcggagaggttgcagtaagccgagattgcaccattgcactcccgcctggtgacagagtgagactccatcttgaaaaaaaaaaaaattattggcacaagtgcacataactctcagcttcctcatatggttgtttattctgcaggtgttttgctgctgatattcacagaacctctctggttacgtattcttttggtctgggtccactttgaattcagttactattgacttgtgtggtagcttttatattattttattcaaattgtgtgcatgtatgtatttaagttacacataaattagaataatgaaaacaggtgcttcttcttaagtgcttgtgtgctataggtctcctatagatagataggtaggtgaatattaaattctgtaggttgctgattctctgtctgtcttctctgtgaccctgagttggaaataatttgactttgaagtactaactagtacactacagttaaacttcttgagggcacaaacttcagtcactgcttatcttcagcatctagaatagcagtatataatcttctctataaatatttgtcaaatgagagctggatgcggtggctcacgcctgtaatcccagcactttgggaggcggaagcggacggatcacctgaggtcaggagtttgagactagcctgactaacatggagaaaccccatctgtactaaaaatactaaattaggccagacgcggtggctcacgcctataatcccagcactttgggaggccgaggtgggcagatcacgaggtccggagttcgaggccagcctggccaacatggtgaaaccccgtctctactaaacgtacaaaaaacccaaaaaactaaaaactaaattagccaggtgtggggcatgcctgtaatcccagctactcggggggctgaggcaggagaatcacttgaacccaggaggcagaggttgcagtgagccaagatcgcaccattgcactccagcctgggcaacaagagtgaaactccatctcaaaaaaaaaaaaaaattgtcaaatgaatcaaataaatcctaaaggaaattaaaataagtaaggacctagtttttttttaaaatcaaatgtccacacatcatgaacagctccaggtccaatactggctcctttgcttattagcagtgtgaccgtgggcacgttacttacacccttttattagcggtaaaatgggagcgttactcaccttgttagaattatggaataaaatgaggtgatataaataaagctcctagcacaatgctctgttcctgcagaatgtgcagtcagcaagtgttagttccttgctcatttccttcccgctctggattttgatttttggcctctccttttggaaaccttcagtgccttctttagggcatgacctgaggctggatccagggaaccacacgggtgggtgccttctgagactcccatcctggaagaggccagccttcctcagacctgttcacatctccgccaccttttgggtgcagtgcagccccggttttgtttttgaggctgctgatgagctcgtattttacttttatccctgtttctgatttgtattctaaatccattaaatttctttttgcaaggatctggtgactgagccggagttcatctaacatagctcttttgtattttggaacatttcctgagcatattttgttccagtttgttccaagtgctggcctcacatttcctttgttggagttgccactgctgttctctgccaggttgacttcagataagtggcagagccacacccttgaccgctgggtccggattcattgccttttcttctggattaaactgttggcccctactctcttctgtgccgctaacctcccagagacacccgctcagaacagtgtcaagataacagacatggataggatttttccactgaatttcaaattgcccaagaagaggctgcagagtgcctgtgagaaatgagcagatggccaggcgcggtggctcatgcctagaatctcagcactgtgggaggctgaggcagatggatcacctgaggtcaaaagtttgagaccagcctggccaacatggtgaaaccccatctctactaaaaatacaaaaattatctgggcgtggtggcgtgtgcctgtagtcccagctactcaggagactgaggcaggagaatcacttgaacccgggaggcagaggttgcagtgagccgagatcgcgccattgcactccagcctggcaacaagagcgagactctgtctcaaaaaaaaaagaaaaaagaatgagcagctgcctggcgggcacagaggtgagccccctgcatcctggccaggactcttctgccagaccatcactccatgctgataggagacctgggacccatgtggagcagctggaaatgatatggactgccacgtaatgtgaccctaaaatagctcaaggaagttatatgtgagtggactctatttaaacagtcttgctcattatcctttggaaaacattggcatgtgttttcttttgtcaagggaggctcaaaattctgggcactcaagattgcagggcaggctgtggtgctctctcctgcctgatggggtgtggctctgctgggcgggcctgggtcttatcagatcttagattggaatcagcctttcctggattctgcaggtggccagtctgctgtggtgacaccatcctgtgctccaggcctttcgggaacccacccctctgttgctgtccctgcttccttctcgagctgctcctagcaggcatccaggacttcagcgttaaagaacagagggtttcagagaaaacatttggctttggggaagagagctccattccaggaactgcacatcaggtgcactgtctagcattgtggatcttctgactggttccattgcatgcatccatctgactgaagtgtggattatagcaaaagatcatttgcacataaagctttttggaaagcataagtaaccaggttaataaatacagtaacaatgagagagaagacagcaggccctcagtcatggctccaccattttatagctctagagccttgggcgaggcatggaatgtcatggccgcagcgtccccttctttaggatgaggggtttggacctccgagtgctctctagggccccgtctccctctaacaactccatttcactgtccagaaatctggttttcaggatggtggccccgggacatctctgacatccgccagctggtggcctaactgcttcccacaggctctgtgtctcatctccactgcctgcccctgcattcgcctgtccgtccttccctccctgcccctgcgctggctgcccgctgctcctcgacgttctgtttccctggccgttcttgtggcctgtttctcaccatattgttcccagaatctggaattcaaccctgaactcatcctaaagtcatatccatgtctgccaggtctttcttccaaagtcaattccagtagaagctctggttgtcttcttcagccaggtccctcctgccatcccctttcttgtgtcatggtgccactttctgcccgctgcccaggaccaagtgtccgtgtcgaacctggtctcacagagtcagcccccgctcctgctcatagccttgcattacggaggctgcagaccgctgcttctgctgattcaatgtcagagcaaatccctgcagcgacctcctccctggcctccttaaccctgtgtgctaacctacccttctgtcttggaagggcacttccatcacagtccactcttagataaaggcccagccccttcgccgtacctttctcccactcagccctgggcatgacccacaggacccacccgccaacctctgtgtgtgacccttggaacccacccgccagcctccaggcgtgaccctcagaacccacccgccaatctctgtgtatgacccacagaacccacctgccagcctctgtgtgtgacccgcagaacccacctgccagcttctgggcatgatcctcggaacccacctgccaacctctgcacgtgacccacagaacctacccgccagcctccgtgcgtgattccaaacccacctgtcccttgctggccttgcacgcgttgccccttgtggaagctgttcttgcacctcccagagaccctgagcctgcccgtcctttgggcacagctgcagacctgcccctctgtggggattgcctggcctggggtcacggggattttcctgtgggtctttctgctgatgtcacctcatttgctcctttgacgcttggcattgccattactgctctgtgatttctgtctgtgccttggcagtgagggctgacttccgggtttggggccagttgaccagactgtgcaggaagttaggaaaaggctttgattcagtggcatgtttcccattgtgtgcagatagtggacactcaatagagcctcgctgagtgaattagtgaagttgtcgcactttcgccttggcacccaacgttactgccttgctgcctcactgattaattgaaggctattttagccaagtaacctttagccagactcagtctctctccccatgtccacagctggccttcaagtctgttttttttgggaagcccagtgacattgaagtggctggcacagtaggacccaggcagtaggttttactgagggaacggacatcctgttgcctttctcactcagtgatgacttggattaccagccagttgacaaccaaccatctttgtacccttctaacctctatctcagccttttggaccatttctctttccacctgttctctatggaatgtagctcaaacaaaaatgttctgaagggaacttagtcatccctctaaacttgtgatagatagagattcatggacccacccttataaaactgctttcttctcggaagtcttgctgctcttatctgttccccagtttgtggtttgtcatctgaaaaaaatacatagggctgtggggctgtgattcggagctgtgattcatcaataagacccacaggattgtcagcgttcttcagttatgtgtttgtgccttcctcatgagccagggaaaggctggggttaccaccggggcacggcttctgaggagggtgagagaaggaggctgttatcttcctatggcaagtctgccatgtggacccattctgtggaaatgtactgtgtcatttatcttagtttttgtgtttttcctgcatacactgcactgtgtcgtttattttagtttttgcatttttctagaggcagggtcttgctctgttgtccgggctagagtgcagtggcacgatcatgtttcaccgcagccttgaattcctgggctcaagtgatcctctcacctcagtctcccacgtagctgggatgaaggcatgcgccaccatgcctggctaattaaaatttttttttttgtagagacagggtcttgctatattgcccaggctggtctcaaactcttggcctcaagggatcctcctccctcggcctccgaaagtgctgggattacaggtgtgagccaccatgcctggcctcactgtgtagttgtgaatagcttaatagtttgcaatgtggtgcttctcacagctcttctctgtaatgggaacatgaaaaattacctggtacagttttatgctttgtggtgtggcttttaatttttataaacatgtcttactgctattgccagggatttagatttttaataaacttccagattcaacagtatttttcttcatctcaatgtctcatttttcatcaaatttaaacaaagttagattctctgggcttgaaacaattttgattcatttcactttagctctgaagtactgttttgtaaaatgtagcacagtgatactgaaccaagctttttgaaagcttattctctgcagggtacatttaagaggacttgcctatcagaatttttacatttcagtcccagaaactatgtgtaacaatacctgttggattctttaaatctggactttattaagttgacagaggtattgaagaatagatgaccaccccgaaatgaggaataaagtttgttttgtacagttgtttaagcataaaaatagacagatattaatagtagtcagagtattcagttaccaacctcttgtccctcctcactgaagatctggtgacaactctaatccacgtggcgtagagagcggtgcctttggtctaatccgaatgctcctcctcttcactggggggttctggggacatctcacctggttgtgccctgggttttgccctgagatgttagcctccagctctgggggccttgtctcagtctgggcatgtgtacttgctcaaattacagtatctcaacttccatatattctgctttggaaaaaactaacctacacttttatgtattacatcctgatactctccagcagtctgtcatataccaaaacaggtcttttgtgaacctatcagttaacagacactttgagttattgcatggccttgctctctgccagccagtagttcatattcaacagcagtgccatccctgtctgcaaggctgtgttagtgcagctattttttatacttcatttaatttattatgctttttcatttgctttgatttttaataaaagtaaaacaaaaataaaagtgctgatgagaagcattggtcttgaaacattaacacaattgagaacaagatgaaatataattttttaggcacatggaaagcagcgagtctttcacctcatctggacattaattggacctaagctgatctactctgtcacttaggaaggaaatgaaaagtaaggaacagtatgatatgttggaaccacatggtcgaaggctggacttaaaagagcagatgcaaggagagatctggcaccacagatagagcatccctaatcccaaagtccaaaatctaaagggctgtaaaatctgaaggtttttgtacactgacatgatgccagaagtggaaaattccacacttaagtacttaacacattgttccatgcacaaaattattaagactattgtataaaattaccatcagactataaaatcatttataaaaattcagttgtttcatataaggtatatatgaaacaaatgaattttgtgtttaagcttgggttcattaggaatatgccagtattccaaaatccaaaaaaaaaaaaactgatcccaagcattttggataagagatactcatcatgtatagcttaatgttctgagctggaactcctttaataaggtggaagtcagttgttcagctctcagtttgactcttaaatatgttttcagcaaatgttcagcttagagtctttgcagagaatgtttgcttactcagtttctgtggaaggcttttccgttaccctgcacagagggccgtacccatgacagcagataggatcgctgcctgggcctcaggggtcttcccctccccggcttgccgagagggagagagagagagagagagagagagagagaatgagagagagagagagagagagagagaatgagagagagagagagaggagagagaatgagagagagaatgagagagaaacagagagaatgagaatggtggtggcggcgacggcatacagagggttcattgttaaacctctgaatgttactgcttttgactttttaagttttaaacaagaaacaggtcataccattaactatccctctgagtcagaaaatatagacccaagagttgcctgttctaatgtggcactaccataatttgttctaacatttcctaatgactgtctgtttctaattatttcattcaagatatgcagtaagtatccttgggctaccagtgaagtgataccatttgtatctcttcttctgtgctttctcaccacttgacattctttgcccatttttctttttctttttctttttttttttaggtagagtcttactctgtcacccaggttggagtgcagtggccatgatctcggctcactgcaacctctgcctcctgggttcaagcaattctcctgcctcagcctcccgagtagctgggattacaggggcatgccaccacacccagctaatttttttgtatttttagtagatacagggtctcaccatgttggccaagctggtcttgaactcctgacctcaggtgattcgcccacgttggcctcccaaagtgttgggattacaggcgtgagccaccgcgcccagccccatttttcttctgcattgctttcttattgatttataagagctttttatctattaggtatctttactctttggtgtatgtgttgtagatattgtttccccacctctcttatcttttggctttgtttatagtatcttttgccataaactttgaaaaccttttaatgttatttgcactgttctatttataccatgtgactttcctgcatacactgctctttttgctacatgtatcccatggtgttttggagtttttgttgctaatgtgaatgggattttttttcctttccactgcaactggatatagctaacatagagaaaagctattgacttgtgtattcttgttcgtttccagacaactggctaaattttatccagtgtttagtctgttgagctctctaggctacatctccaaatctatctccatctctagtcatagcatctccaaataaaaataattttatctcatttcagtactatttatttcatttctttcttttatagtgcagtgaactagatgtctgtcaaagttattcaccctctcttgagggtaaaatcatgtccttcttgccatctgagctgcaggcgggtgcctcctcatgtgacatcatcacgttgcctcctcacagcagaagctcttggtatcaaatgcttccgtagccagtgttgtgcagtctgctttcttccaactagattctgagctctttaaagttggggatcatgccccttattttatgtccctcacagaacctcccagagaactgggcatgtagtaagtctgtgtagggctgtctgtatgtgtgggaggtgtccctgttctcctcttctgcctccccgctgcttcctggaagccagttctgacctcttgggactgtcgatcatatgaccataggactctgtccccaagggcccttcctccttgcccaccctatagaatttagatttttgagcctctagaccaaagaaacttcccttctcaaaactttattggcgtcagcatcacctggagagtttgttaacacagatcgtggggtcatccccagagacttgaatccagaggtctcaggtggagcccgagaatttcacattttgaacaagcttgtttgctgctggtccaggtagtatagtttgagaagcactgctctaggctgcagttggtgacctcatggatgcaaggcaaagagtgctttgcgcaagtaagccagattcctgtggaagtttaagcctcacgtagcagggcccctgccctccaccctgaggtattgcgctacaagtcagagtatgtttcaggggcatgcggcatttatcttttgcaggataggagattctgtcatgaaaagcattttttaggcctaagaaaaactcacccccctcttcctcagcctctgcgcttagataccttcatgaaaacagaatcatccatcgggatctaaagccagaaaacatcgtcctgcagcaaggagaacagagggtaagtgacctcctgggactgggaaagcctcaggtgggcgtgccgggaagtggcctgggaggaaaggagcacactctgcatatttgtgtgtatttgcatttccttgcctgtgctttgattctctgggaatgctgtttgatttgaaacaaaattgagcaaaaaagttgttgcagattgaggcaagtttaaatggattacattgttagttgctcaagttgcaggaatctgataaggaaaataatgtttgccttcctacctccacccctagcctctgggactagcgcttcttggaagtcgactttttgttttccatttgctttaagagcctcgcctctcgactctaaatggaaaccagtggtcagttggttgtggatgtggctgggaagaggcactgggagctggcctctgctgccaagcctggtccagcctatagtttccccagagctctttgtggcctcctcagtggccacccggctcagacgtggtgttgactgccccacaagcttgacattgtggtctttacccacccactctatgtgttcagctggggtggtgagcacaggctcagctgagtggaatacagtgaatgagttcttagatcacctaatcccttcccatacagctgcccttagcacctaggcctggcctgtgactaccacagggctcgcccttgttccagttcaccctcactcctgtcagtggtgctcagatttgagaactgagggcatttactgagaagaggctggcccggtccttcctgtttcaagtctgggtttagctgtcttgagggctggtgcctgttctgttcattcagcttccctctgatgatgcgtggcagagtgtgggaggacacgtgcctagcatttttacaatatgccttttcttttagccctgaatctaccgtgtcgagggcattcttttgtgtatctggtggctcttaggagtttgggatctaatagtacctgggaattcagaaatacctctgctctaacaccaggcagtcagaatcctcgtagaaggacattgtgttcttataaccctcagctttctccttccttttgttttagttaatacacaaaattattgacctaggatatgccaaggagctggatcagggcagtctttgcacatcattcgtggggaccctgcagtacctggtaagaagtgggccttgcctgtttgcctgtcagctcctccctgctgctgcatttgtggggctcctgtcctgccttgctcccagcacctgagtcccaccggctctctgaatgttttggagatgcatgaggtcacacccataacctggtcgagtcagcattttttgccaccagatgccctgtggagggatgtggtcgtcttctctgatgtccggagggctctgctcatgcgccttgcaccatcccctagcctctctgtgcttcagtgtcttctctgaaaggaaagggttttaaacagatccatgctggtcttgagcggtcctcccacctcagcctcctgagcagctaggactacaggcaggagccactgagcctggccgaggccacactttccatgaggtatttcaggggccactgagtaggggtcagagctctgagctccccaccctttgtttacgttatttggtctgaatattaggtttctgtttgagtcactcattcattcaagcatattgatggagtgtagtctgtgtcaggcactgtgctcagggctggtgatgcagtggggaaaaaagacaagcccttttcggccttcagagcttagggtttagcaggaaagcaagcattactgtgatgcttacacagataactaagaaattacagttgtggtgagtgttacaaagcaagagtgcagggtgttgcaagaatatatattgggtggcctcagcctggtctgggacttgaagggtaaggaggtgaaaagggctggaggtgggggacggcagggggaattccgtgcaaagggatcacacacaggaagacctgcaggtgtggctggaaccgagcacaaaagggaaagagagtcttgagttgaagctgagaacaaggtagagcacagattatgaagggccttcagggctgggctaaagttctagactttatcttaaaacctctgcagagattgatgggttttaagtgggagaaggagcaactctttggaaagcccactcctgacactgtgtggagaaggaatcacactgaacaggagggaaaagtgggtgaggtaggggcagtgaagatgtagagggcaattagattccaggagggcttagcacaaatgcccagcaagacttgtcataggttgcttgatgatggcagtagccaccacaattgggagtgactcaaggagtctgcggctttcagagtgggtctcacagagggctgtgattcaggcgcctgtgtccatatggcatgtgatttggtagatccttctggagtcctcctcagctcagcagcagtcgagcaagggggaccccatgctctaaccaggagctgagtcaagtcatgtactcacatgagctaaaacttctgcccataaccagacatagaggttgacctacccatcccggaatgtcttctcttggtttggtctcccgggcccttccttaagcttcacatttccaaccagaccatgcaccaccctgtctctgtgcttttgcttgccccagtcatttctgtctccacccacctgctaagcccagtctgcacccccagcaccccgtgctgccgccccttcttcggtcaccccagcgctctctgcctcagcagcagccatgcatcacactttccctgcctgtttctaaatatcctggccctttctgcaaccacatggtacctggttcaggggttcaaccagcacttaatgcgtgtatttggtgtggacagcctggcatcattttcctttaacatttgtagcctctcttcccatttctacacagtgcccacgactgtgtcctgccttaagctagttttcaataagcgcctgaaatgctgcaaccctttttttttttttccttttttttctttctttctttcttttttttttttagacagagtctcactctgttgcccaggctggagtgcagtggcatgatcttggctcactgcaacctccacttcccaggttcaagcgattcttgtgcctcagcctcctgaatagctgggactaaaggtgcacaccaccatgcccagctaatttttgtatttttagtagagacggggtttcaccatgttggccaggctggtctcaaactcctgacctcaagtaatgcgcctacctcggcctcccaaagtgctgggattacacgtgtgagccactgcgtccagcctgcaaccctcagttttaaaggagagaagttaaagcctagcgatgggtgtgtgatgtactctggccctgaatctttagcccctccatcagtacctactggagtgagtgggacatagaaaggtcttagaaatggtagcatgatatacccgctaaacatgcctggggtgccctcctcgccctgcatgcatgtgccagtgccctctaggatgaagccaggggtgaaagcagatgggctggccgccccctcctgccgtggtccccccagagaggagcagctcaggtgtaccccctcctgttgctgcaggccccagagctactggagcagcagaagtacacagtgaccgtcgactactggagcttcggcaccctggcctttgagtgcatcacgggcttccggcccttcctccccaactggcagcccgtgcagtggtgagtgggcccggggcacctggatggaggagggagcctgtctgttcctttctcttcacgtaccctgtttccctggcgccccatcaccgggcctgggagatctgtgttgtttctcttccgagaggaaggcctgtcaggacctagcacgagtaggggagtggtctgtgctccaaggacctgttaatagatagagtagctgttaagtcttcatgtggattctgagccttcacatctttaaatacaatgctgtgtcagtgtcatctgctctgtgttcagaagtaagactattgtatgaatatacgcacttacactgagaatgctgtgtgttagtaaacaaataaaacacgtgtacacatgacaagtcaggaggaaatatgtgaaaatttgttgttgacaaatgttactacaacctgaatataaatttttgtttttaaagcgtaagaatgtggccgggtacagtggctcactcctgtaatcccagcactttgggaggccgaggcaggtggatcagttgaggccagcagttccagaccagcctggccaacatggcaaaaccctgtctctactaaaaaccctagccaggtgtggtggcgggcgcctgtaatcccagctactcggaaggctgaggtgggagaattgcttaaacccaggaggcagaggtcgcatcactgcaatccagcctgggcgacagagtgagactctgtctcaaaacaaaaaaagtttaaaaaaaaaaaaaacaacagctgagcataaagcataagaatgtagctgaaattgtgaacctaataaattacacaaaaatttttccagtaaaaattaaaggatatgatgaagatttgtagaattaccctgtattctttagcttttgttttactgattaaagaaataatgcattgtgcaggatatgtttatataaaagttaattatcaccaccaaaaatggtatgtgaggtaatgtatatggtaattagctcaatgtagccatcccacaatgtgtacatcatgttgtacaggataaatatagaccatttttatttgtcagtttaaatcaagaactgggggcagaaaagaaataaaagttaattattactgaaagccataatttaaaaatgaatattcccccaaatcagttagatttcatttaggattgttccttgagaggccacacactagtttaaatgatgctactctgctcaaaatttacttacttcaagttttattttttttggaaccgtaataagttcatgtggctcaaatttccagaagaataagggagtatgcagtgaagtcataccagcctcccaggccctcatttacctccccacaggcacctgctgtcttccaagaatgttttcatatcttccaaggtgttcgtatcttccaggggtgtttgctacgtgttccagtaaattggcatatatttgtttatttgtacattgatgtttcccctcttttttatcccaatggtagcattatctgaacacggtcctgcacatgctttcaagcttttcacaccatgagaatttctttttgagccaatttatctgcaacacaaaaaattattattttgaacttaaatagtactgcatagtttaattaccccctcatttttgccagattaactttgtttcatttttgtgttttggaaaatatggaaacagtaaaaaagcaggaatcaactgtcatcccataattggaaaacaatcactatgaacagttgtgtgtctccaggctcttcagcgttatatttttgtactttttaaacaaaaataggttactataatcttcatacaacgtgcctttcaaactagatatcaaaaatgctgtatgtttttccttattatttgtaatgtctgttatttcactgaatggctgtgctgtggttcatttaacttatcccccgtggttggaaggacgttgataatttttacttcttaaaataacaccaagaataacatccttgtagggaaattcttgcacacagttgtttccctaggataatacctagaaagggaaataacagattaaagagtttgcacgttgtaaaggtttttgatgcatattagttagcaaactgctcaccaggaaggtcatataaatacacgtctccacctggagtgtggacactgcccctttcaccacatccttgccaacactggctattgtcaccttctggaagtaatgaaaacaaaacatgaatgttttcagaggacaagtgtctacatcttgagagtatttgtttataagaataaagtgggccaggcgtggtggctcatgcctgtaatcccagcagtttgggaggccaagatgggcggatcacctgaggtcgagtttgaggccagcctggccaacatgatgaaaccccatctctgctaaaaatacaaaaattagctgggcatggtggcacacgcctgtaatcccagctacttgggaggctgaaacaggagaatcgctggaacccaggaggcagaggttgtggtgagccaagattgcgctgttgcacttcagtctgggcaacagagcaagactccatcttaccaaaaaaaaaaaaaaagaaaaaagaaaagaaaaaaagaataaagtgtatcctttgaaatcaattccagaaaagtggtcttaggtgatggcagtctgttcaattccacgtttacctcccagtgagggaggtgtctgccctgagttttgagaagtggcaaagtatgccccactatggtgacttattttaaaacaggcattgctcctttagctacataggttctggaatattgaggaatttgttcattaatttatagtcacactttatagtatacgcattataaaaatagctttaaattgcatgtacatctatagtgggtttttttgtttttgtttttgttttttgagacagaatctcgcttttttgcccaggctggagtgtagtggcgcgatcgcggctcactgcaagctccgcctcccgggttcatgccattctcctgcctcagcctcccgagtagctgggactacaggcgcccgccaccacgcctggctaattttttgtatttttagtagagatggggtttcaccgtgttagccaggatggtctcgatctcctgacctcgtgaactgcccgcctcggcctcccaaagtgctgggattacaggcgtgagccaccgcgcccggctgtagtggttttaactaaaggaattattgcatttcttcaggtcacttgttgagcatgtctcttatttatgacaagatgagttaaaatccattagaactagaagaacaggtgctttttgaaaatacattcctaatggcccagcgtcttcataggaaatctgttgtctgcagagccatcttcctagagcttccctcatcagtgctggaggaccaggtggccagtttcaagtagatttctctgaaacccaataaggagctgttttgtggactatctagtttttaatgctttgggaaacttttaaaaaatttcactatcttatctcagatggcaggtaaatagtaatttccagacaaatgcaatttgggctttacaattctattataaagccactttgaaatatattttaggacaagcccaagcaataagcatcttattttgggtccttttctaatttcccatcaacagcctaagttttctagcagaggcttattccacacttacataattagaaagtcttggagcccccgacttagagctgtcagagtttcagcccaagctataaagcaccagcctctgccacgcaccggctcttctagctttccagtgccagtgtgctcccgataggccggttcaccacttgccaatgagaattgtttggagcaaagcattttttatttgaatttcctagatgttttgaggaaaaaccgtagttggacattcagacagaatagaaagaacaccagacattgggtttgagcccctgattctgctactctgttgtgtgaccttggacaaatcatttgatcatcatttcctttagtccaaattgggggactaaaaataatgtctgccacatgggcctgtcacggcaataagtgaataaatgatctgtgtcagagtacttggttatctatgaagtattattcaaatttactcttcttattaccaagatttgaagccatttgtatgtagattatttttactggccgggcactgtggcttacccctataatcctagcactctgtgaggccaaagtgagcgaattgcttgagtccaggagtttcagactagcctaggcaacatggtaaaaccccgtctctacaaaaaatacaaaaatttgctgggtgtggtggcgcacaccagtagtcccagctactcaggaggctgaggagggaggattgcttgagcctacaaggtcgaggctgcagtaagttatgattgtgccactgcattccagcctgggcgacagaaaaaaaaaatttttttaccttcagatactacttcacataccccaagaagttccctaagttgggaaatgtataagttcatttatccttagtatttagctgtgtacatttagagggaagtatctatgtgtgtgcgtaggttttgcatattttatgtaaatgtcgtatgcatgctgtaatctaggtttggaagtcctaattttaacctctgtcaaaacacaagagtgtgtaatagatgaaatagaaggtagagcaagggagaaggaaaagccaaggatgagataaggaggcagtggtactatctgcagaactctgggcacaagatggtcagtgactctgctaaaggttgctcttcaaaaactcatccaggcagtcctgaccagtcttaaactctcaaagaatctgcctgactcgatgtgaatgaactgactgctattccaaaagactggggctataagtctcctgtatagttgtaaacttatattacaaatgtaaaatggctcttgagtgctaagtgtcgtagggatatgtatgactgtatatttcattgacatcccagtcaacaattgactgcatagatgacagtggtctcatgagattataatactgtatttttactgtaccttttctgggtttagatatgtttagatacaccaatacttaccattgtgttaccctggcctacagtattcagtaccggagcatgctgtacaggtttgtagcctaggagcaatagggtgtacgatacagcctaggtctgtagtaggctaaaccatctaggtttgtgttatgttcacacaaggactaaaatcacctaatgacgaatttcttagaatgtgtccccgtcatagcaacgtgtgactgcacctaacaagattcatatttgcaggcattcaaaagtgcggcagaagagtgaggtggacattgttgttagcgaagacttgaatggaacggtgaagttttcaagctctttaccctaccccaataatcttaacaggtaaggcacagcggcattacacgaatacatatctttcttgctttttttagaaatacaagtcttggctggccgtggtggctcacacctgtaatcctaacagtttgggaggctgaggcaggtggatcacctgaggtcaggagttcaagaccagcctggccaacatggtgaaaccccgtctctactaaaaatgcaaaaattagccaggagtggtagcacgcacctgtaatcccagctactcaggaggctaaggcaggagaatcacttgaacccgggaggcaaaggttgcagtgagctgagatcgtgccactgtactgcagcctgggagacagagtgagactccatctcaaaaaaaaaaaaaaagaaaaaagaaattcaagtctgaagtgacatctgataacttttaaacaggctatcaggatatcgtcctgtgactaagaaattaacatagtccttcttaatcttaaatctggaatgggttttcctcccttatctccctagaaatcatctcttttctaagttcacataacaatttatctatacctcttattacccttaatagcctctaccttgtatcacattcggttttgcatagggtttatctctgattcaacagcagtccttttaagggtagggaattataccttatttctctttccacccctcatgtggcccaattctgtgtcacagtcaacaaataaatctttgtcatttgaatggcattacaatccagtctcagagccagaatctaaacaattaataatattgtataattgtacagaattgggtaacagtgcaaaagaaagctacaaggcagtcacacataattgagtgacatggataatgattaccatatttagagggtggaagagatgattggatggattagtgctatatggaatgacgtgggataagctagaactttttggaagggtctagacagatgtacaggacatggatagatgaagagaaaggaggaaggaaattctaaggggaaagattgaggtgagcaaggcacgtttgggaggtggtgagtagctgtgttggcctcagggaagggtttgagtgctcacaggaggcaggctctgcagggccaggggaaggagtttggagtttgtcatgtgaaccgctatatctggcagcatgggatctagattctgtaggggtcacctaagctaggatgtgcctataaagtgtatttttaaaacctcatgggttattctttttccccttctttcttcctttctttttaagacagagtctccctcttgtcacccaggctagagtgcagtgtggcacagtcttggctcactgcaatctctgcctcccaagttcaagggattctcccgtctcagcctcccgagtagctgggattacaggtgtgcatcaccacgcctggctaatttttgtgtttttagtagagatggggtttcaccatgttggccaggctggtctcaaactcctgacctcaagtgatccacctgctttggcctccccaaagtgtgggattacaggcatgagccactgtgcccggctctcatgggtcattcttatgcagccatttggaggtcagcaatctctgatttgggggtattttagaattcaggagagaggtgtgaacacctgaataattgattggaaatgtttatactgtttctgataaacccattttcattttcaatcaccgtctactggctgccgtctgtgtgtatactgggagacgcacactgtagcccaacattggctggaagtgtctcctcacacactatgctcctctccacagtgtcctggctgagcgactggagaagtggctgcaactgatgctgatgtggcacccccgacagaggggcacggatcccacgtatgggcccaatggctgcttcaaggccctggatgacatcttaaacttaaaggtgagtgtggagccaagttagccctgaggcaaaagctggggtccccagtggaacatgcagttcttaggacagagcaggggatggggccagctgacctagtgaggaaatttaggctcctgcatcagtctttctgcataagtaaagaaaggacagttgtgctaattgacattggctatgaggtcatagccacagacaggattatgaaagatgcaaatatgcgaaacatggcacatgacctccctccctcaagctaggcccttgctttgtgtggttgggaaatgttgggagtagcagagagaggacctaggcaaatagatgggcatttccttgaagaaatcggttttccagtaacatctgggttgtgttgcagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaaggtgagccctggcttcgtacacaccatcctgtttaccttggctgtgcctcctgggaaactcaacacactttcagatttcaattctgctttgtcatgtagtctgttaatcacacagtgcggatacctggctggtttttaagttggagtatggtgtcctctgtgtggcctgataggaaacacaaatctccttgctggacttgttacttccaaaccctccaagaccggtctcttgcctttattgcaaaaaatgatgctataacactcgaatctctcaagttgcctgcttggccctcttccaagtgtactaaaaaaaaaaaaaaaaaggatgctgcactttcttgagtcaactgaaagtatttatgatggcctctgtgtacagaactgggttaggcacctgtgttaactatagctgtgtaagacatgacctctgctcaaaaagaccttctcagctgacttgtggagctaaagttatcatatgagaaataatcattgcatagggaagtatatagtgaatttctgaacttcccagggaagacagagagtaaaatagaatgtaatacgtttgtaaataaagagtgtgttcagacagtaagtgtggctggaaacgttaaacacttcatggatgcttcctacttgctggctgaagatgatgctcttgctgaacagtggggaaagctgtggaacttcttcattatcagttagaaaagagagggttggatccacaagattcattttgtccttgtccctttgcagttaaatgagggccacacattggacatggatcttgtttttctctttgacaacagtaaaatcacctatgagactcagatctccccacggccccaacctgaaagtgtcagctgtatccgtaagaatttgttatgttttgtttttctaaataatccgttataatatgtgggacaaggcagggaagggagactggactaaggaagggggagccacgtaaaggaaattaatatcgccagtcctcagggcagccttccttatttaggacatgcaaggagtagccaggcaagagagagtacaggaaaccattagttaatttcaacctcctaggacgggcgtggtggctcacacctgtaatcccagcactttgggaggctgaggcaggaggatcacttgagcccaggagttcaagaccagcctgggtaatatagtaagctcgcaagtctactaaaaatttagaaattagccagatgtggtggtgcatgcctgtagtccagctattcaggaggctgaggcagaaggatcacttgagcctgagagttcaaggctgcagtgagtcatgatcacccccactgcatgccagcctgggtgacaagagcgagaccttgtctcaaaaaaaaaaaaaaaattctgttgaaaatatatggccctatatacatatgtgtccaatggttcgtaaagtgttccttcaaatcaacagctacttattgaccactggtacatgctgttggtacaaatacatgtatgtgacagtaaccaggcataacaccctccaaagttacatgatcctatagtaggtacaaaacgtgaaagtgccagtagtgtcgaaggcaggatatggttaattgtaggagagttattgtggttattctttgacaattgcttgtgtctctgtctccagttcaagagcccaagaggaatctcgccttcttccagctgaggaaggtgtggggccaggtctggcacagcatccagaccctgaaggaagattgcaaccggctgcagcagggacagcgagccgccatgtagcgtgccaggctttttttttaaacttaatttatttaaaattccttggtggctttggccacagggaggtggttgaggcagggacccagaagcaaccgttatgagcaacaaaaggaagacactggtttggatggacgggaagcggttgggtgggctggactgacggaggcccctttagacctggcgaggtgagtgtggttggcacagggtgaggagtgtggaactgaagctgggctggccaagctgtggctggtttgggaacccagaggagctcactaccatgtggattagcaaaactcccctgaccgtgctgctggggacttacggactctttcctcattgtgactcgtttgccaacattattggccttttgtgtcttcctttgcctgatgtcaagtttagtgcagaacctcaggcattgctgagggctaggaaattgtccttgggttataagtggctgctataataatagtgatgatgataataattatagcagggacctcccttgacatttgagggggttttgttattgtacaggaaatggaatttggatcccagagatgctccaagactgttccttgtggtccctgcaggatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagtgagtgtgcactttgcaatgagtttaaagacaccatttttttttctttttctctttctaaggtttcttttgtcctattataattgagttgcttatttctgtttcagttttgtggtgtttttattttgttttgttttgtttttccttctcaattttttttcagcatcagataaactgctgctggcctggagggaaatggagcaggctgtggagctctgtgggcgggtaggagactcattttgggtttcggaacttaccaagggggtgagattttgtgctcccacttttcactttctcatcaaacactgggtcgatctctgtcaaaaatcaggtgttcctcaccatgctttgagcttaactggaccagctgaaaagaggccaagagagtagccagtgaagggagcccctctgtggccagatgcaagagctgcatgaatggacagagatggtccaggtttaaataagaagcaagggttaggttcccttggggaaaagccaagaccatttcctgttaggaagggcattggattgatgatcaacactccctcttgtcgaaggtttttgactaattttgttgggatgctaaatccataggaaataaaaggtctaggcagaaagtctcagggcagcgtaaatcagatgtcaccaaaaaaagttaattatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggacgacctgtgagtactggctggggggcccctctgtgcccagcacacacagacagccctggagcttcggtgtgtgtgtcaagggcaccctcagtggctgtgcgggaccattctctagagcatgcttccctgtggggtcacttccagcaaatcatcactgagcttcagtttccaaatctgttcagtgacaagaaaaacagtcttaagtcacgaagttgtaaggatgaattcagataatgcatttgagacgcaggccataatctgtaaaggctgtaaaatgcaagcagcctctacccctgtagcagactcccctgatttgttccacccaccctgactcaggcatagctcagagcagaaagtaaaacagagaaggaagaacctgatgaggcttaggagtttggacctggaaactattcgtttgagtctttgtcaggtatttggcattggctccatgaggggcggaggggtctaggcagatcactcctacctgaaggagatcacatgtgctcctggcgtacagatggagggaaccaggcaggccgcttgagggctgtgtcaccgtgagctcagcagtgttccctgattctctcactaggattcttaggacaggagctccaaatgtcagaactttgattctgtattttctctaattaaccctttattctcctctagttcttttatttgtatttgtattatttttttaagagacagggtcttgccctgttgccaatgctggagtgcagtggcacaatcatagctcactgcagcctcgacctcccaggcttatgcagtcctcccatctcagcctcccaagtaaccgggactacaggcgcatgccaccatgctcagctaatttaaaaaaaaaatgtttttggctgggcacagtggatcacatctgtaatcccagcaccttgggatgccaaggcaagaagattgcttgtgagcccagaagttcgagaccagcctgggcaacatggtgaaactctacctctaccaaaaaaatgtaaaaattagccatatttgacctcaagtctagacagaacttctttgtatattttagagaggagcaagcaagggagctgtacaggagactaagggaaaaacctcgaggtaagtggggttctgtgtctgccttgggcttctccttatctcatttatggggcatcactactctctgctggcttccttgaggaactatgctaccctccctctctccagaccagcgaactgagggtgacagtcaggaaatggtacggctgctgcttcaggcaattcagagcttcgagaagaaagtgcgagtgatctatacgcagctcaggtatgagccccgaccttcctgctctggaggaaggactgggagatgcaggtatgaggtcaccttcctccctcctctctgattcgctggacctcatgaagagagtttctgcagctgctgactggatgcacagctgccacaggttctgctttctccagcccaaatgccattagtttgccatgtttattctttgcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtgtgagtgagtgctgtggtcccgggcccttggcctagcagcctcctgtgcctttccacctctgtgcactgccgccatcccacacgggacaccacagagccaccagcagcccactcagctgctgctcgggcttcacgtcgctgttctttgacttggtgtaagcggggaggtcagaggaagggcctgtgctaattgttttcattcatctgtgtattactttcgtgtggctactgtaaagattagcacaaactgaggggctaaaacaacagaaatttgggctaggcatggtgactcatgcctgtaacgccagcaatttggggaggctgaggtgggaggattgcttgagcccaggagttcaagactgcagtgagctgtgatcatgccactgcactccaacctgggcagcagagctgtctctactaaaaacaaaaacaaacgtgttatctgagctctagagcccaggagttgaaagtcccgtgtcagcagggctgagctccctctgagggctcttggggagggactgtccttgcttcttccagctcctggtggttccaggcgttctttggtgtgtgactccagtctctgtctctgtcttcatgggacccctgtgtcccttatctgggtgactcttacaagaacacttgtcattggatttgagtcccacccaagtagtccagggtgatgtcatctcaggttctctaaagacgctttctccaagtacggtcacactcacaggctccaggagttgggatgtgggcatatccttcttagggccaccaattcagcccaccgtcatgcacggcagtgcaacttggttgaccatcgtctgcgtctgcactgccctcagtgcagtaagccacgctttctgtgcacaccgtcttaacgtagctgtgagtccatgggatgccacatggtggggaaatgggaaacaaaacagccaagaactgagacgggcaggcctggccgtgttgtgggagccagagctgttgggactgcaagccccattgtgaaaggctgcagagaaggtgacatggatgaaagagtgatttaggtgtcagtttcccttaagagcaaagggaaggagagagggagatggttgctcatggtggaagcaggagatggtgcattaggagattctcattgtcaaaggcagaggggacaatccacacacagtgcagagaacagaggggctggggtcgcatgccagagcactgagcatgccttgggagcgtgattgacacatcctcctgtaagaagagaggaacgggagaaaacaggatgacgaggtagagaggatctgaagaggagagggaggtgcaggtatgcgcaggtgatagcctgatgtgccatctacatccattgagcatttactgaatgctaactatatgcccagcaagacacacaggtgagaaggcatggcacctgttcccaggagggcctgatccttcaaggggcacagacagaggcatgagtgagagccgttcagggcaggaagggctaggaagcagctccaggaggcatgagctgcagtttctgtgcacagggggagctccagcttgtcttagaggagagggagcaacaagaaggttcacaaggagctgttccagctgaagagtgaggatgttccaggacagagacactgctttatcaaaggcagagagcctggggagtcagtgtgttctgagtggggacaggctggtgtgtgtggggaaggccacaatggaggatgaagctgctgaggtaggcaagggtgagcttacgtgggccacgcttcattttctttttttttcgagacaaagtctcgctctgtcccttaggctgaagtgcagctgctcaatctcagttcactgcaacctccacctcccgggttcaagtgattctcctgcctcagcctcccaagtagctgggactataggctcatgcccccacacctggctaatttttgtatttttagtggagatggggtttcaccatgttggccaggctggtctcgaactggcctcaagagatctaccccccttggcctcccaaagtgctgggattacaggcatgagccaccgcgcctggcctatgtccattttcaaagcacacaggacacatggcagtatctgtcttttcccttgatattaaaggaacttgagtgtagggatatgatcacatctgggatttggggaagtccctctccaggcagctggaggatctgagtccctggccaacctcagcactgagaagggccgctcagcaaggctggagttgagccgccgctgtgcagcacagaacagggtggggcaggagctggggcagggcctggctgggagggagccaggcagtgcaggagccatcccctgccatactttcggtccagggcagaagcacaggaggccaatgccgggcctctccccaggcatggtcagcagggaaggtgcagcaggaggaccaggaacgggaggcttgggtgcttaacatggcttcttgatgtgtgggccttgaggtttcgctggaggggaggatgtggagccaggatggttccacggcctgagggacacgtgaggggatgaaggactgcaggccgaagtgagtgtcaggtgtggggcctggggggctacatgggtgggttggggaccatgcagggcagagatcagcagaggggtgacctgaagattggccggcggtcgtgggctgtgagctgaggaggctcaggtagctggaatgggaacccctgcttgacccttcgggctgggaggggcagtggctgcagccccttgggagtcagggtgtccttgtttcttctcagccaggtcatagaggatgcaagccacaggaattcccatagcctttgtgtgtgtgtctgtcttctacctggaaaacagtaagaatactttcctgttcttttcttgtaaaagttcattaaggggctggatgcagtggatcatgaatcccagaactttgggaggctgaggcagatcacctgaggtcaggagttcgagaccagcctggccaatatggtgaaacaccgtctctactaaaaatacaaaaattagctgggtgtagtggcacacacctgtaatcccagctacttgggaagctgaggcaggagaatcgcttaaaccccggaggtggaggttgcagtgagccaagatcgcacatcgcacttcagcccaggcgacagagcaagactctcaatcataatcaatcagtaaagctgatgaaaataaaaaagcctgcaaattaatgtaggcacccaggtctccttaaatttagaatcctttcctcaaaagtctccgttgatacagaaacacttttgaagccagatgtgaagcaccagttgacccgcaggtgggggtgccaactggtaggctgtagggttagctctggcctctggcagccagccagttgtctcctaagaaaatactgtggcgtgaatgcaaaatgtgattcatcacttggctcctaatttcttttgattttgtcccctagagcaaggtccgtggtcctgtcagtggaagcccggatagcatgaatgcctctcgacttagccagcctgggcagctgatgtctcagccctccacggcctccaacagcttacctgagccagccaagaagaggtaggtcctccttagcagtgccaagtgtgaccatcaagggcacgtcaggagatcggggatggaggcgtttgtcactggtaaatgtctgtctgatggtattaccacctctctggatgtttgttgcatctgctgggtcctgtggggacaaaagtgatacatgtttggctctcatagtcccttgaaacttactaactagtttctttgtccaaggcttggatgactaactgcttaatgagaacattggaaatgctggtcaggcacatgctgttaccctttatccataggaagccacattcccttcagggaggccctgaagccctctgcccccactcaccctaccagtaccttgagttaccgagtcaccaccctcctcccggtgccactgaccttcccattcttcccgtcctctccctcctcttgcctgaaccatcgcagcagaggtgggggcagggctttctgcctcctgcctcctgcctttctgctgccaggccctgtgtggttgaattaatcttcacgaaataccactctgaccaaggtgttccttagtcagtcataaataacagcttctccctccattatagatgctcaggtctgagctttcgtcaagtctcatctgggccagcagtgcatcatcaaattctcaggtcctgctggagacctcacttgagagctcagggttggggcccagcagtctgtgtctagcagccctccgcccgttctccagcacactgcaggccacttctgctcccacgcccatctcttcctgtgttttgttttgtttgacaccttctgtgtgcagggctctatgggttcctgcaggctaatctctaggcatgggaaacaccgatgattacctggggcaggggaggaggttgggagtgactgataattcaaggtttcttctgaggatgacgaaaacattctgaaactagatatggtgatggttgcacagctctgtaaatacgcgaaaacccttgaattgtacactttaaatgggtgagctttatggtatataaattatatctcaatacagtctgctttgaagaatcttgttcttgtccttgggagtttgtagcctcttttggtgtttatgtgaccttggatacttaattttctcttggctgtatggcacgcgcttgtaatcctagcactttgggaggccaaggcaggaggttcgcaggagttcgaggcaagtctcctgggcaacatggtgagactgtctctctctctctctttttttttttttttttttttgagacagactcttgctctgttgcccaggctggagtgcagtggcgcgatcttggctcactgcaacctccacctctcaggttcaagtgattcttctgcctcagcctcccgagtagctgggactacaggtgcatgccaccacaaccggctgattttttgtagttttagtagagatggggtttcaccgtattagccaggatggtctcaatctcctgaccttgtgatccacctgcctcagcctcccaaagtgctgggattacaggcatgagccactgcacccagcctttttttttttttttttgaaatggagtttcgctcttgttgcctaggctggagtgctatggcacgatctcagctcacctcaaactcagcctcctgggttcaagcgattctcctgcctcagccttccgagtagctgggattacaggcatgagccaccaggcctggctaattttgtatttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaattttgtatttttattagagacagggtttctccagcctgttggtcaggctgatctcgaactcccgaccttgggtgatccgcccgccttggtctcccaaagtgctgggattacaggcgtgagccaccgcacccggccctttttttttttttttttttttaaataaaaattatttccccaacctctcatgagctcctggagtatagtagctagaccgggagcctgttccattcccttctggggcaggcactgagcctttaggctagctagaggccccatagatgaggcttggcagaaatgtgctctgagctcctgccatcagattgtcacattttgcagagtgagaggagttccagggcagtcttcctttatgtggcttattcccttcagtgatgtcctcaaaggtctagaaaggtggacctgggtatataggatgtctctcgtctccccacagcatagagctgaggttagaaaaagacggatgttttactacatgctgctctttttcactgtggcccagtcctcagaggaaacatgggtttcttattatagaaaagagagagatcagattagatgaaaccaaatcccagaacttgattttcaacagattccaaggaactgtgaatcctgataaattccttggccttttttttgtctacttcaaaaattggaaaacaggtgatttggagaatatctttagattttggcagtttgaaaattaaattcagctatctagtaagtcagaaagcagaaagaggtttttttgcttctgacttttattgagatctgtttgcttttttgcattttggacagtaacgctcatatgtggaaagtgcataacaagatgaatgaaagtattagtcagtgggttggtgttttaagacactcaggatcaaaataattgttacttcatttaaaaagtattatcaaaactctctagcatattttaaaatagcagtgttagctctgataactaataatgaccactttctaataatttgatcattttctttagtgaagaactggtggctgaagcacataacctctgcaccctgctagaaaatgccatacaggacactgtgagggaacaagaccagagtttcacggtaacagcttgtgtgagactcctgcgattccatgtcctttctttctatggcaaaatagaagagaaaatggaaatgcaatctggcattatcctcaacctcagtgtttgtttgtttgcttgtttatttgtgacagggtctctctctctcacccaggctggagtgcagtggcatgatcttggctcactgcaacctccgcttcccgggttcaagtgattctcatgcctcagcctcctgagtagctgggactacaggcgtgcgtcaccacattcagctgattttttcagtgtatatttataattttctagtacacattttttattattcataataatagtgatgtctaacaattattgaaggcttacaactacatgtatgcattatcttatttaatccttggaacacttaattccgatgatgaggaagaaggtagcattgttcccagaagcctgtccccacctgcaccattggtactactgctgagtatttgtgtgttgagtgctgggctgggagcaggaaccagccatggccttgtcctcagggccttggagcttagtggtaggtagtactagttatgagaaaactagccaagttacaggtacattaagacaaagcttccattgttgagagaatcctgcatcatttgcttagatctttacatggcctttacctgctaatcacttgctaacctcccctaactttaagcttttggaagaattacaagggataccactgtgaattgcagcctttgctgatgtagtcgcatgtcctcctccagtctgtggacattctatatctcttgctgctctcctcctcctggcatgataatgttttgatcagttcattgcttacttgcatgtctgtgggaggaagaggaagtctcatcaggccaagtcatgtggtgaggctggaaatccataactgagattagctacccacagtgagcatgggagtgagtgctgtgagccacagtggtactgacgtcgactttctaattcccacagtcacagaatctcaaggactctgagccaattcaaagaaaagatcctgtacagtttgaatatgtaacttagcttaagagtaccctgcagtcacaagatttattaataaaagggtttggctttttaatttgtatttgtttaatttatttgttttatgcagcctgggtcttgctatgttgcccaggctggtcttgaactcctggcctcaagcgatccgctcgcctctgcctcccaaagtgctggaactataggcatgagccaccatacccagccaataaaggggtttcaatatatttctttttattttttattttttgagatggagtcttgctcttttgcccagggtggagtgcaatggcacgatctcagctcactgcaacccctacctcccaggttcaagtgattctcctgcctcagcctcctgagtagctgggactataggagcttgccaccacgcctggctaattttgtatttttagtagaaatggggtttcaccattttggccaggctggtctcgaactcctgacctcatgatctgcccaccttggcctcccaaagtgttgggattataggcatgagccactgtgcctggctgggttttagtatatttctcaattgtcctgatttcctcctgaagaggaaaaataacctgaaatgtgttggtggctgttgtttttttaacatgtctgttgactttcaggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaag

SEQ ID NO: 893 - DNA, 61353 bp, Homo sapiens; identical to SEQ ID NO: 892

SEQ ID NO: 894 - DNA, 61353 bp, Homo sapiens; identical to SEQ ID NO: 892

SEQ ID NO: 895 - DNA, 61353 bp, Homo sapiens; identical to SEQ ID NO: 892

SEQ ID NO: 896 - DNA, 61353 bp, Homo sapiens; identical to SEQ ID NO: 892

SEQ ID NO: 897 - DNA, 61353 bp, Homo sapiens; identical to SEQ ID NO: 892

SEQ ID NO: 898 - DNA, 72927 bp, Homo sapiens
cttttctgcccttctttgctttggtggcttccttgtggttcctcagtggtgcctgcaacccctggttcacctccttccaggttctggctccttccagccatggctctcagagtccttctgttaacaggtgcatgggggtggggtgggggactctgggtggggaggagggtaacttttgggtctgtcataaatagagggcccagaatatgtaggagtcagtctggggagaggcaaaggggatttggggaaggagaaagggttcaagaagaagcagggagaacagctagacccagacaggctggccagggaagcctggatgaatgaccacattcatggactgtgcaaggctgcttgccggtccccttgcttcacacatgaggagacggaggcccagggaggagaagtgacatggctcagggtgcgcagcaggtgtgagacccctttcctgagtgcttcctcctggatcccctctcaccatctccactttgcctccggttctattttccaaggtcccgggtgcaaatgtttgttgaatgactgatgaatgaaaatgatttgagtttgttaccttttatgcttatatgttgtggaaaatgaaattctcctcaaaagggaaggaaatacttgagagctgcataggaaggaaattatctaattaagaatgtatagaaacttcactgttgggcaaatcatcgttgtgacaccgggggaagaagccatttaggtgctcagaagggaggctggaattcagagcaggactggacgtgccccacgacggtggttcttaggtcaggagtcagcaaacagtggcctgggggcccgatatggcccacgacctgtttttgcacaacctgccagctagagattgaagatgaacactgataatcgatttgatgatagggagcaccacccccaaagaattctatttgtctcatttgtaaacccgtattacaaacaaattgtactcaatcattatgtttgaaatttccctaatgacaaatttgtggaaaagtattttctgtcttgttatataagtacttgtacaacatattctatcagcctcttggtctgcaaaacctaaaatttactatctggctgtttacagaataagtgtgctaatccccgccccaggctaacagagctggacctgggaggcagacatctggatgctgggttagttagggtgaccgaatggatgggaaagggaatggagcaggaagacatgctgctatcttttttttttttttttttttttgatacagggtctttctctgttgcccaggctgtagtgcagtggcatgatcatggttcactgcagccttgacctcctgggttcaagcaatcctcccacctcagcctcctgagtaccactacacccggctaattttttattttttgtagagatggggtctcactgtgttgcctaggctggtcttaaactcctgagcccaggtgatcctcccacgtcagcctcttaaattattgggataacaggcctgagccaccacacccagccattgctttcttttaaattattattagtttttgttttttttttgtatttaattttgagataggatctctctctgttgctcaggctggagtgcagtggcacaatcagggctcaagtgatcctcctgcctcagccctccaaagtgctaggactacagcccctaactggcatgctactttcctctgcttgatccttcccccattctccctttagccttgaccttatgtcatgggttcaacttggacactgaaaacgcaatgaccttccaagagaacgcaaggggcttcgggcagagcgtggtccagcttcagggatccaggtgagacccttagatggagccccctttctcagtgctttctctccaagacttacatacctgaaaaaaatcagcgatttgagtgatctttttcaacagataaatcaattcaaaatatacaacaaattcatcttttgaatttacagtattctaaattcaaaagatgcaaaagggtgtaagagtaaaaatctcttccttactcccttcccctagttcccttcccaggagggacctcacaaatggtttcctgggtgttccttcggggagactctgtgtgtgcataacacatacacgttccctccctcagccaacacaccatgtgtagtatacattgtactgaaattaaggcctgcctgcaggctgccgcctatttttgtgaatgaattttattgaaaacaactccgtccacttgtctcttactgtttattgcccttccctcccttcctcccttccttccttccttccttctttccttccttccttcctccctctctcattccctgcttccctctttccctccttccctcccttccctcccttccatccttccttccttccttccttccttccttccttccttccttccttccttccttccttccttccttcatttctttctttcctttctgacatggtcttgttctgtcattcagcctggagtgcacaggtgaaatcatagctcactgtagactcaaactcctgggctcaagcaatcctcccaccttagcctcctgagtagctgggactacaggcatgtgccaccacacctggctaattttttgattttttttgtatagacgaggtctcactctgttgcccaatctggtctcaaactcctggcctcaagtcatcctcttgcttgggcctcccaacttgctgggatgataggtgtaaaccactgtgcctggctatggccacttttgagctgtaatggcagaattcaggagctgtgatagagattgtatggaccctgaagcctaaaacatttacctttacagaaacagtaattgtggaggtgatagtacctttccagaagaagggggctggtctctgctctttgctttatctcccataatacagcccagtgatttgagtccattaatcccatgttatgcttgcattgcatgccataattgggagatgctataatttattttattttatttttttagagactccctctgtcgcccaggctggagtgcagtggcatgatcttggctcactgcgacttctgcctcctgggttcaatcgattctcctgcctcagcctcctgagtagcttggattgcaggtgcctgccaccacgcctggctaatttttgtatttttgtagagacagggtttcaccatgttggccaggttggtcttgaactcctgagctcaggtgatccacctgcctcggcctcccaaagtgctgggattacaggcttgagccaccgtgcctggcttgtaatctccttttacattacattagatctcttgttaatgaacatttagattgttcccaaacttttgctctatgaacaatgctgtcattttgcacatgtgcaagcctatttggaagtaaaggctaggactgggattgtggtatccacgggtgcatgagcacgtgcaattttaatagatttttccagatccccctctacagtggtggcagcaatttacactcacaccagaaattcatgaaaatacctacttcctcatactccctcactcatttgccaactcagtgtgctatcaaacttactgatctctgcagatcgagtaggtgagaagtggtatcttaatttagctttaaattgcttcttttttttttatgagagaggcattttctgtgaacatgtttttcttatctgttggccatttttctttctttttttttttttttactagtttgtacaagctttgagtacactgaggaaagtagtctggggtatgagttgtgaagctctctcccttgtgtattatttttcttttgagtatgcttatggtagtttatcacatacaaaaatttatttatttatttatttatttatttatttatttatttatttatttattgagatggagtctcgctttgtcgtccaggctggagtgcagtggagtgatctcggctcactgcaacctctgcctcctgggttcaagcgattctcctgcctcagcctcccgagtagctgggactacaggtgcgtgccaccacgcctggctaatttttttgtatttttagtagagatggggtttcaccatgttagccaggatgttctcgatttcctgacctcgtgatccacttgcctcggcctcccaaagtgcagggattacaggtgtgagccactgcgcctggcccagaaatttattgaaaatgactgtgtggaggctgggtgcaggggctcacgcctgtaatcccagcattttgggaggccgagctgggctggtcgctggaagccaggagttcgagactaccctggccaacataaggaaacctcatctctactaaaaatacacaaattagccaagcatggtggcacacacctgtaatcccagctactcaggaggttgagacaggaggaatgcttgaacctgggaggcagaggttgcagcagtgagccgagattgcaccactatactccagcctgggtgatggagtgagaatctgtttcaaagaaagaaaataaataaaaataaaaataaataaaatgactgtgtgggccgggtccagtggctcatgcctgtaattctaacactttgggagactgaggtggaaggattgtttgagcccaggaggcagaggttgcagtgagctatgattatgccactggactccatcttgggcaacagggtgagaccctgtctcaaagaaaaaaaaaaaatggttggcctgggactacaggtgtgtaccaccatacctggctaatttttaaaaacattttttgtagagatggggtctggctatgttacccgggctagtttcaaactcctggcctcaaatgatgctcctgcctcaacctcccaaggtgctgggattaaaggcatgagccatggtgcccagcttgaattgacctatttttatttttaaaatttattcatttattttttgggacagagtcttgccctgtctctcaggctggagtgcagtggtgctatctcggctcactgcaacctctgcctcctgggttcaagcaattctcttgcctcagcctcccatttagctgggattacaggtacgcaccaccacgtgtggctaattttttgtatttttagtagaggcggggtttcaccatgttgcccaggctgatcttgaactcctgagctcaggcaatccacccccttggcctcccaaagtgctaggattacaagcatgagccaccgcgcctggtcctatttttaaatgacttctggtttttgtgtcattcttaggaagaccttttctcattctgagtcttaacattttcccatttttttctttgctaattcttcctcctagtcataggaatttaggaatccgggtatgggcccccaccgtcctctgggtggcagaacttcctctgtggtctccttctctccccacatgtcgaagttttctctgttcccacttctccccacagggtggtggttggagccccccaggagatagtggctgccaaccaaaggggcagcctctaccagtgcgactacagcacaggctcatgcgagcccatccgcctgcagggtgagtcactgccccgccgggctgggactgggattcccctgtgaacacatagggactttccaggcactcctgtgtcctggggatctgtggtggggacacaggtgcctgcctccgtaccctctcctctgcctgcagtctctaccctagacatccccaggcaacccctctgtgttcctttctttcccaagatttaggatcccccttcaccgtcagacctccttgtctcccgcatggaggtgacccctgcccagctcttccacagccttctctgtccccccaccagggtgaccatgcccatatctgtccccgcagtccccgtggaggccgtgaacatgtccctgggcctgtccctggcagccaccaccagcccccctcagctgctggtgagtggggctcgatcagaggagcatcctaatgggggtgtttgggggcccacgcatggtggggctgggggtcttgtggagggtggaggtgctggggtacaaggacaggaagcaggggcagccccttccactggctcctgtcccctaggcctgtggtcccaccgtgcaccagacttgcagtgagaacacgtatgtgaaagggctctgcttcctgtttggatccaacctacggcagcagccccagaagttcccagaggccctccgaggtgggttgcctttggcagagggaacagatgcgcagcaaaagaccaggggagggggcaggactgaggtgacgtctgctcaaggtctgggctctgggtgcagaagagtgggggaactgggtcccattagagtcagaagctagggaggtgctagggtcttgtactttaggaaaacgccttggctaggcacagtggctcatacctgcaatcccaaagctttgggagcccaggagcttgagatcagcctgggcaatgtagtgagatcctgtctctaaaaaaaaaaaaaaaaaaaattagctgagtgtggtgatgagcacctgtagtcttagctatttggaggccaaggtgggaagattgcttgaggccacaagttcaaggcaagcctgggcaacatagggagatccccgtctctacaaaaaaaaaaaaaaattagccaggcgtggtggcacacacctgcagtcccagctactcaggaggatcacttgagcctgggaagttgaagctgcagcaagttatgattgcaccactgtactccaacctgggtgacagagcaagaccctgtctttaaaaaataagtccaggtcacactgcagaggaggggatggtgcaaggtgtcattggcaagaggtgggaatcttggggaccatcctggggggcggccttccacacccctgttccccaaacctctgttgattgagattctgagtgactgtatggatttttttttttttttttttttttgaggcagagtctcgctctgtcacccaggctggagtgcagtggcacgatcttggcttactgcaacctctgcctcccaggttcaagcgattctcctgccccatcttcccaagtagctgggattacaggtgcccgccaccacacccggctaatttttgtatttttagcagagacggggtttcaccatgttggccaggctggtctcgaactcctgagctctggtgatctgcccaccttggcttcccaaagtgctgggaatgagccagggaatgagtggggggcatgagccaccatgcctggccagagtgcgtggatctttcaagctgctttttcccactgctttgttcgatggctatgccatctttttgcttgtcttcatgttgattctgggaccacaggcgaatgtttctcccttgcattttttttctttctcaagccctgttcctctatatttcaccctccacagttaatcctccttcctccacagagaaaacaaaagcttcaggcatggactccctccactttccccttctcttattttatcttaataagcggttttccagtcttcactggaatttgttgacaaattctaaaggagctgtaacaccgcactttctcctttttctcaaatttccataatgacagcactcctggcagtgactcactcgttttagaggaagacctgtctctcctctgtcccatgactaaattcttccatatgggcttttgagagtctctcatgcaccaactaaggtgatcacctatctttcttttttcttttttttttggagacagggtcttgctctgtcacctaagctggagtgcagtggcacaatctcggctcactgcagcctctgcctcctgtgctcaagaaattcttgtgcctccgcctccagagtagctgggatcacaggtgcgcatatactgatttttgtattttttgtagagatggggtttcaccttgttgcccaggctggtctcgaattcctgggctcaagagatcttcccacctcagcctcccacagtgctgggatcacaggtgtgagccactgcgcctggcccagcatctcttgaatcacttgttttctctctaggacaattaacttcccccttcctctggctgtaaacactcttcattctatctgtatctgaaaagcaatcaaccaccacaatcgatagccatgaaaacaatcttctctcttccagtctcctcctcatctcctgccatctctcctcaccctcaccacccaagcttcctgagtgcattctcttcacccccggctggcctccagcttccctctccacctaggggcactgggttctgggttctcttttcacccacgtgttcttctttcctgaaatcacccagttctgtggcttcagctaacacttctacctctccctctttagacctcactctcagggttcaagactacttctttaaaaaagttttcatttattaaaaaatatataatacatacacttggttcaaaattcgaaagggtgcggtagctcacacctgtaattccagcactttgggaggtcaaggcaggaggattgtttgaggccaggagtttgggaccagcctagacaacataatgagaccccatctctacaaaaaatgcaattagccaggcatggtggcgtgtgcctgtggtcttagctattcaggaggcctcccaaagtgctggggttacaggcatgagccactgtgccctgccagtctttctaaaatacaaaacaaatcatctcacttccttttctaagaaccttctgtggctccccattgcctacagataaagtcgagctccttattggagtagaaaggcccttgcccgctgctctttgcttgatgccaccgctgtgtctccatcgccgtcacatacgtttgtccctgtagtgctgtttccatcaaacggcattcctggattctgccagaatccttttgaggcccttgtcccatatatcagtaggagtctcaactgggaccaaaagcacattccagtaatgtaactgcccaaggggttcaccttgcttgctgcctagacagagccgattcatcaagacagcagaattgcgatagagaaagaataattcacacagagccagctatgcaggggaccagagttttattatcactcgaatcagtctcctcgagcatttgggggcagagtttttgaggataacttggtaggtcgcgggggaagccagtgagctgggagtgctgattgatcagggatgaaatcatcgggagtcggagctgtcttcttgcgttcagttggttcctgggtgggggcagcaagatcggatgaaccagtttattgatctgggcagtgccagctgatccatcaagtgcaaggtctgcaaaatatctcaagcactgattttaggagcagtttagggagggtcagaatcttgtagcctccagctgcatgactcctaaatcataatttctcatcttgtggctaacgttagtcctacaaaggcaatctagtccccaggtaagaaggaggtctgctttgggaaagggctgttacgatctttgtttaaactataaactataaactataaactaagtgtctcccaaagttagctcagcctacacccaggaatgaacacggacagcttggaggttagaagcaagatggaatcagttaagttagatctctttcactgtctcagtcataattttgcaaaggcggtttcagtaagatttatttacaaagaggggggtttatttataaagggagtaattataaagctgtgacaggcctaagggagccatcagggactttccaagccctgggcaagcaggtctgttgccacccctgggtttatgggttgaggagagggagagctcaccagggtctggagagagtcatgtggagctggcttccttctgaggaacagttggtcttttgtgaaggacatagctgtccccaaacaacctcaatgggagaacacccggacctcactgccctcctccctctagtcttctgttgagccccctcatctgccaaatccaatgggaatccagagggcaacagagtcctggtgatggggtccctgcaggttgacctcccaggccacagagctgagcggcaatgggtagaaagtggatttggggatggggcagaaggcagaggagcacattccacatcactttatatgtgtgtgcccttcccttttctagaatctactccttttgtatatctggcaaatccttccttccttccttccttccttcctcctttgctttcctttcctttcctttcctttcctttcctttcctttcctttcctttcctttttttcttcctttcttccttttcttcgaagtcttgctctgtgacccaggctggagtgcagtggtgcgatctcagctactttttgtatttttaatagagatagggtttcaccatgtcagccaggctggtctcaaactcctgatctcaagtgatccacctgcctcagcctcccaaagtgctgggattacaggtgtgagccacctcgcccagctgggcaaattatttcctgttcttcaagattcagtcaaacatcaccacattccctgattcccttgggcagaattaacgaaaattttccataccactttgtccttgtttatttacttatttatttatttttaagagacagggtctttctctgtggcccaggctggagtgcaatggcgtgatcatagctcactgaagcctcaaccttttgggctgaagtgatcccccaccctcagcctcctgagtagctgggactacaggcatgtgccaacatgcctgactaatttttaacgtgtgtgtgtgtatatatatatatatatatatatatatatatatatatatatatatgtttttaacgtgtgtatacatatatatatatacacacacgttaaaaattatatatatattatacataatttatatatatatttaacatctatattttttatagagacggggtcctatattctcattgttcagcagagggctgacatgcaaaaaaacccaaaacaccaagtgtcaaattacttgattcatactcttttccccttccccagggtgtcctcaagaggatagtgacattgccttcttgattgatggctctggtagcatcatcccacatgactttcggcggatgaaggagtttgtctcaactgtgatggagcaattaaaaaagtccaaaaccttggtgagggcccaggggtaggttagggaagagcccacacggggctggaagatacatggcaaccgggccaccatgttctcctcccagttcaactgcagacattgccaaattgacgatcgattatggtttgccttcctgagtctcttttctgctctgttggatgcagcctcagcattctttcagccttttataaagcgggcagctctaattgttaaggttggcatgggagatgaagcccacgtgtcattgctggctgagttctattttcatttttatttcttatttttttgagacagaatctcactctttctctcaggctggagtgcagtggtgtgatcttggctcactgcaacctccgcctcccgggttcaagcaattctcttgcctcagcctcccgagtagcggggattacaggcgcatgccaccatgcctggctagtttttgtatttttagtagagacggggtttcaccattttggccaggctggtctcaaactcctgacctcaggtgatccacccgcctcggcttcccaaagtgctgggattacaggtgtgagccactgctcccggccgctggccgtgttctagtattgaggagagatgggagctgctggcagctctccgtcctggtgaggcaggggattaggggcagcacagaggaggaatttggagagtggagtgtttaagatcttcgtggagcttgctgggagatgtctgaggggtgggggcaccttctccagcatcacaccagccgccccctccgcagttctctttgatgcagtactctgaagaattccggattcactttaccttcaaagagttccagaacaaccctaacccaagatcactggtgaagccaataacgcagctgcttgggcggacacacacggccacgggcatccgcaaagtggtgtaagcttccccttttcccttaggatggagggaggaggagacacttttagctgggctttgatggatgaagggagccgttcagacaggggtggtagaggatgcttccccaccggcagaggtggggaggctgtgcgtggtgtgttcatcaaaggacaagttgtgagtgaaaggtgggagtggagtggggaagtgagggaaaggtgtctggagggaagctacaaagatcagctcaggccagggagccaaaggcagctttacagcctgtggtgagatatcgccatgtctcattttgggaagttcactctgattttgaggtgggtgtagaggcaaggatggggttgggacagaagtacaagaagcactggagagtcctagaggggctggggagctggtgcagtgctctgggagaggtttcctgaaggccaattaactatatatatatatatatatatatatatatatatatatatattttttttttttttttttttttttttttttttttttttgagacagagtctcactctgtcacccaggctggaatgcagtggcctgatctcggctcactgcaacctccacctcctgggttcaagcaattctcctgcctcagcctcctgagtagctgggattacatgcgtccatcaccaccatcagctaatttttgtatttttagtagagacagggtttcaccatgttgaccaggctggtcttgaactcctgacctcaggtgattcacctgacttggcttcccatagtgctgggattacaagtgtcagccataaatatatatatttttaaaattcaaaagtaataatactcagttaaaaaacccaaattatgcgaaagtataaaaacaaaaaccgtgaaggcttcctttcccttccctgctgcttttccaggtctcggggcagttgcatctcagtgctaagtctcaggggagacggagcccctccgagacctcgcctagctgtatctgtgtctgggactctgctgacatttcctttctgacgttaatagcatctctggctaggtgcagggtctcataccagtaatgtcagcactttaggaggccgaggtgggaggatcacttgaggccaggagtttgagaccaattgacaacatagtgagactctatctctaaaaagataaaaaaataaaccaagtgtggtggtacatgcctgtagtcccaggtactcaggaggctgaggcaggagaatcacttgagcccaggagttcaagtctgcagtgagctatgattgtgtctctgcactccagcctggataacagagtgagtgtctatttcttaaaaaaaaaaaaaaactagtgtgtcatctacttgcatttgactttgtccctcctgtttcctgcacagacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtagggaatgcagctctcaggttgatgcttctgtggagggtttctatgtggatccatcctcccttcaatttgcaaatattattaaaatcaaagtgacatgagagctaatgctagctcatatacaccgtatcagctatctgttgccacatcaatgctgtgtaataaactatcccaaaattcagcagcttaaaataataagtaagcctgtgggtcagcctgccaagagttctggtctcaatggccttcctcactgtcattagctacaggttggcaggctgctctgctgatcttggccaggctctctctgtttctgagggttgccagctatgtcatctgctggaccagatggccttgggtggaaccactggggtgacttggccctttggcaacctggctctcattctccagggctagcctgggcatgtcctcatggtgaaggcaggggagcaagagaacagtggagatgttgcaagtgcttttttacgcctctgcatcatgtttgataacatccatgggtgtcacgagcagtgcaaggttagcgataaccaggtccatgcaggtttgtgtttttccacaacatctttcgctgatgctatttcaatcacaaacgccacaagctgcatggaattcccaaggaggcagttcttcttagtgcatcctgttccctcagacactctggctcaagccacccacaagtcagtcaatattgcaaaccatatataatagtatacttaatcaatatataagttataggttaaacattccacagcaaacaaagtaacatttaacatcagaagaaaaagaaagaggagaaaggatgaatgaaaaggactcctggtctgggcccaagggtcctggtcctgttagtcttgcaaggcagagtctttgatacggcagagccctcggcagcaaatgccaggctctcatcatgagcgactgcgaggtgtgagttccaacagctgctttgagctgctgaaggcctgatctcttctagtcacagagctgtctggtgagaacagacagagaagaatgtgcttgtttgcatccttatctggttggatgtagtctttatttgtttattttatttatttatatttatttatttatttattttgagactgagtcttgctctatcgctcaggctggagtgcagtggcatgatcttggctcactgcaacctccacctcctgggttcaagcagttcttgtgcctcagcctcctgagtagctgggactacaggcatgcaccaccatgcctggctaatttttgttttgtattgttagtagagatggggtttcaccatgttggccaggttggtcttgaactcctgatctcaagtgatctgcccgccttggccttccaaagtgtgggattataggcatgagccactgcacctggcctatttaaaaaatttgtttaaaacgaccttatccttgttggcaaagtgccctgtgaaatatagaatggagcctttttctaagatggagtcagttatgtcaagggtgctctgtatacaatgggctaaagcaagactcatgtctgagcccagaggcaatgaagggggcagatgactccaccaagagcaggagggcacagcagagtgctgggggaaagggcttggatacaggaagaggcaaggagtcaggatcatcagtgtaatcaaactactacagcacctgcatgacacagaaagcgatatcaccatggatacatgccttggcacgtaggacataccttcatataaagaaaaaggctccccttcctctagggggaggtcagctccataccaggagacgtggcacagcagatggatcagcagccgggtttctgccccaacttgcttccttggcacagtgccttgtgcagtgtacaacctgcccaactatacctggcaaccctgtcccagggaccttctgatgcatttcctcacttgataaataatggttcagactagtttcctgcagaattgtctttgccagatgatattgctagcctcacaccatgatttagcctctgttccttggtaacaggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtgagtcaggcatctgtgttcccagagcagctccagaggcagccccccaccccagaacatagtcccctctagaatccagaccttcctaacccttggtatcccccagcatcaactctctccacttcctacagctcccagtcccagcctcacttggtcaattcctttgaagtcaaagaatccatacttttatctgtaattttgcaaatcttggctataggctggtaaattggagtatgggggagtcaaatcccacccagtattttaacaaaaatttggatgtgttgccagctgtcgtctgttcggttctctgttgtatcccaattgcctagaatagtgcctggtactcagaaggtgctcaataaatgtttgttgaataaaaggaatttagaaattgggggatttcataaacagtctgggtttatggcttatcttgaaaagctggaagattagacaccttgaagaccgcattcccacttggcaggatgttgctggaggtgaatggctgccatccttctaagagggacgtatgctgtccagcttgacacagatcctgtcggagtctcctttgtctgtggccaccagagcacttgggttttcagtacctgttctaggttcttctgctttcttttcttttctttctatttttttttgagactgagtcttgctctattgcccaggctggagtgcagtggtgcgatcttggctcactgcaacctctgcctcccaggttcaagtgattctcctgcctcagcctcctgagtagctgggattacaggcgcataccaccacgcccagctaatttttgtatttttagtagagacggggtttcaccatgttcaccagactggtctctaactcctgacctcaagtgatctgcccatctcaggctctcaaaatgttgggattacaggcgtgagccaccatgcccggccttctgctttctttaatatagaaacttctcctctttacaggtactcagacaggaagtagcagctcctttgagcatgagatgtctcaggaaggcttcagcgctgccatcacctctgtaagtggcccttcattaaattgcgggggtggggcagggggtagcaagaagagataggagagatgtgggggtttggggactcttctctgtgatagatacttgggaagtagctctgtgaggggcagcggttgtcccttcttccttcctcatcaaccctgttctacacctttcccagaatggccccttgctgagcactgtggggagctatgactgggctggtggagtctttctatatacatcaaaggagaaaagcaccttcatcaacatgaccagagtggattcagacatgaatgatgcttacttgggtaagtggggagggcaagggttactctaagaaggggtgaggatttggcataagtcaactagcatagatgtctgggtcttgaatgaatgggatacatatgtatgggatactagctattagtctcttgggatagctttaaagacagaaacttcaatttttttttttgaggtggagtttctttcttgtcgcccgggctgtagtgcaatggcactcggctcactacaacctctgcctcctgcgctcaagcgattctcctacctcagtctcctgagtagctggtattacaagaatgcaccaccacccctggctaatttttttttttttttcgaaatggggtttcgctcttgttgcccaggctggagtgcaatggcgtgatcttggctcaccacaacctccgcctcccaggttcaagcgattctcctgccttagcctcctgagtagctggaattacaggcatgtgccaccatgcccagctaattttgtatttttagtagagatgggatttctccatgtcggtcaggctggtcgcgaactcccaacctcaggtgatccacctgcctcggcctcccaaagtgctggaattacagacgtgagccaccgtgcctggtctttttttgtattttcagtagagaccgggtttcaccatgttggccaggctcgtctggaactcctgacctcaggtgatccgcctgtctcggactcccaaagtgctgggattataggtgtgagccaccgcacccggccagaaacttctaaattgaattgtaattatgttcataaagagaaatatagcgtagggatcagttaccccaacacagcaagcgtggggctgccccagtgcccctactcaaggggtgggtctgcatggtggaggagggggcagggaatgcacttcacctctcagacccccaccttcaggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccaggtgagtgcggtttgtggagcatgaatgtgcaaacagaggcgccctggggtcttagagattccaggaggggcattcagatgacatgcatggccctcttgtaaaggaggctttgggggctgtgagctggggagttgtgggatcagcttagcatttgtgaatgctgtgtcctcagcttttttaacaatgataaataacaatgcttgcctgtacagagctctctatgggtctttctgtactcagggctggtattcaacccgtatataaccaggatagccatgttagttaataaaatattgaaacaattccgtattcattgataaatggtggattccccctcacccatgcactctggtgcttccccagtctctgtgggcttccccatgatccagcaactatgaggtcaggcaggacacttcacacaccctctaggatctgctccagccatgcccctgctcagtacctgtgcagctccagctgttcattattttgaatatcacccctgcaaaagcagcatggtcacatattatgtgggaactagcgagtgaggcaaaactctctagtcaaaatcattcttgcaaattcctgaaataggactgcacccatgatatggtgcctatagttctttattttatttttattttattatactttaagttctagggtacatgtgcacaacatgcaggtttgttacatatgtatacatgtgccatgttggtgtgttgcacccattagctcgtcatttacattaggtatatctgctaatgctatcccttccctctccctccaccctacgacgggccctggtgtgtgatgttccctacctggtgtccaagtgttctcattgttcaattcccacctatgagtgagaacatgcagtgtttggttttctgtgcttgcaacagtttgctcagaatgatggtttccagcttcatccatgtccctacaaaggacatgaactcatccttttttatggctgcatagtattccatggtgtatatgtgccacattttcttaatccagtctatcgttgatggacatttgggttggttccaagtctttgctattgtgaatagtgccacaataaacatatgtgtgcgtgtgcctttatagcagcatgatttataattctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacgtgttgtttcctgactttttaatgatcaccattctaactggtgtgagatagtatctcactgtgattttgatttgcatttctctgatggccagtgatgatgagcattttttcatgtgtctgttggctgcataaatgtcttcttttgagaagtgtctgttcatatcccttgcccagtttttgatggggttgtttgattttttcttgtaaatttgtttaagttctttgtagattctggatattagccatttgtcagatgggtagattgtaaaaattttctcccattctgtaggtggcctgttcactctgatggtagtttcttttgctgtgcagaagctctttagtttaattagatcccatttgtcaatattggcttttgttgccattgcttttggtgttttagtcatgaagtccctgaccatgcctatgtcctgagtggtattgcctaggtttccttctagggtttttatggttttaggtctaacatttaagtctttaatccatcttgaattaatttttgtataaggtgtaaggaagggatccagtttcagctttctacatatggctagccagttttcccagcaccattattaaatagggaatcctttccccatttcttgttttttcaggtttgtcaaagatcagatggttgtagatgtgtggtattatttctgagggccctgttctgttccattggtctatatttctgttttggtaccagtaccatgctgttttggttactgtagtcttgtaatatagtttgaagtcaggtagcgtgatgcctccagctttgttcttttggcttaggattgacttggcaatgtgggctcttttttggttccacatgaactttaacgtagctttttccaattctgtgaagaaagtcattggtagcttgatggggaaggcattgaatctatgaattatgttgggcagtatggccattttcacgatattgattcttcctatccatgagcatggaatgttcttcaatttgtttgtgtcctcttttatttcattgagcagtggtttgtagttctccttgaagaggtccttcacatcccttgtaagttggattcctaggtattttattctctttgaagcaattgtgaatgggagttcactcatgatttagctctctgtttgtctgttattggtgtataggaatgcttgtgatttttgcacactgattttatatcctgagactttgctgaagttgcttatcagcttaaggacgttttgggttgagacaatggggttttctaaatatacaatcatgtcgtctgcaaacagggacaatatgaataccctttatttctttctcctgcctgattgccctggccagaacttccaacactatgttgaataggagtggtgagagagggcatctctgtcatgtgccagttttcaaagggaatgcttccagtttttgcccattcagtatgatattggctgcgggtttgtcataaatagctcttcttagtttgagatacgtcccatcaatacctagtttatttagagttttcagcatgaagggctgttgaattttgttaaaggccttttctgcatctattgagataatcacgtggtttttgtctttggttctgtttatatgatggattatgtttattgatttgcatatgttgatccagccttgcatcccagggatgaagcccacttgatcatggtggataagctttttgatgtgctgctggattcagtttgtcagtattttattgaggatttctgcgttgatgttcatcagggatattggtctaaaattctcttttttttgttgtgtctcttccaggctttggtatcaggacgatgctggcctcaaaaaatgagttagggaggattccctgtttttctattgactggaatagtttcagaaggaatggtaccatctcctccttgtacctctggtagaattcagctgtgaatccgtctggtcctggactttttttggttggtaggctattaattattgcctcaatttcagagcctgctattggtctattcagagattcaacttcttcctggtttagtcttgggagggtgtatgtgtccaggaacttatccatttcttctagattttctagtttatttgtgtagaggtgtttatagtattctctgatggtagtttgtatttctgtgggattggtggtgatatcccctttctcattttgtattgcgtctatttgattcttctctcttttcttctttattagtcttgctagcggtctatcagttttgttgatcttttcagaaaaccagctcctggattcattgattttttgaagggttttttgtgtctctatttccttcagttctgctctgatcttagttatttcttgccatctgctagcttttgaatgtgtttgctcttgcttctctagttcttttaattgtgattttaaggtgtcaattttagatctttcctgctttctcttgtgggcatttagtgctataaatttccctctacacactgctttaaatgtgtctcaggattctggtatgttgtgtctttgttctcattggtttcaaagaacatctttatttctgccttcattttgttatgtatccagtagtcattcaggagcaggttgttcagtttccatgtagttgagcggttttgagtgagtttcttaatcctgagttctagtttgattgcactgtggtccgagagacagtttgttataatttctgttcttttacatttgctgaggagtgctttacttccaactatgtggtcaattttgtaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctgtgtaggtcactaagcacttgctttatgaatctgggtgctcctgtactgggtgcatatatacttaggattgttggctcttcttgttgaatttatcggtttaccattatgtaatggccttctttgtctctttgatctttgttggtttaaagactgtttcatcagagactaggattgcaacccctggttttttctgttttccatttgcttggtagatcttcctccatccctttattttgagcctatgtgtgtctctgcacgtgagatgggtttcctgaatacagcacactgatgggtcttgactctttatccaatttgccagtctgtgccttttaattggagcattgagcccatttacatttaaggttagtattgttatgtgtgaattagatcctgtcattatgatgttagctggttattttgctcgttagttgatgcagtttcttcctagcatcggtggtctttacaatttggtatgtttttgcagtggctggcactggtttttcctttccatgtttagtgcttccttcaggagctcttttagggcaggcctggtggtgacaaaatctctcagcatttgcttgtctgtaaagtattttatttctccttcacttatgaagcttagtttggctggatatgaagttctgggttgaaaattcttttctctaagaatgttgaatattggcccccactctcttctggcttgtagggtttctgctgagagatcagctgctagtctgatgggcttccctttgtgggtaacctgacctttctctctggctgcccttaacattttttcctccatttcaactttggtgaatctgacaattatgtgtcttggagttgctcttcttgaggagtatctttgtggtgttctctgtatttcctgaatttgaatgttggcctgccttgctagattggggaagttctcctggataataccctgaagagtgttttccaacttggttccattcgccctgtcactttcaggtacaccaatcagacgtagatttggtcttttcacatagtcccatatttcttggaggctttgttcatttctttttactctttttttctctgaacttctcttcttgcctcatttcattcatttgatcttcaatcactgataccctttctccacttgattgaattggctactgaagcttgtgcatgcatcacgtaattctcatgccatggttttcagctccatcaggtcatttaaggtcttctctatgctgtttattctagttagccattcgtctaatctttttacaaggtttttagcttctttgtgatgggtttgaacatcctcctttagctcggagaagtttgttattaccgatcatctgaagccttctcctctcaactcgttaaagtcattctccgtccagcttcgttccattgctggtgaggagctgtgctcctttggaggagaagaggtgctctgatttttaaaattttcagcttttctgctctggtttctccccatctttgtggttttatctacctttggtctttgatgatggtgacatacagatggggttttggtgtggaaatcctttctgtttgttagttttccttctaacagtcaggaccatcagctgcaggtctgttggagtttgccggagttccactccagaccctgttttcctgagtttcaccagtggaggctgcagaacagcaaatattacaaaacggcaaatgttgctgcctgattcttcctctggaagcttcgttgcagaggggcacccagccgtatgaggtgtaagtcggctcctactgggaggtgccccccagttaggctacttgggggtcagggacccacttgaggaggcagtctgtctgttctcagatccaagctgcatgctgggagaaccattactctcttcaaagctgtcagacagggacatttaagtctgcagaagtttctgctgccttttgttcagctatgccttgcccccagaggtggagtctacagaggcaggcaggcttccttgagctgcagtgggctccacccagttcgaacttcctggccgctttgtttacctactcaagcctcagcaatggtggacgcccctcccccagcctcactgccaccttgcagcttgatctcaaactgctgtgctagcgtgagcaaggctccatgggcgtgggaccctctgagccagacgcgggatataatctcctggtgtgccatttgctaagaccattggaaaagtgcagtattagggtgggagtgtcccaattttccacttactctctgtcacggcttcccttggctaggaaagggaattccccaaccccttgcacttcccaggtgaggcgatgacccaccctgctttggctcatactctgtgggctgcacccactctcctacaagccccagtgagatgaacccagtacctcagttggaaatgcagaaatcacttgtcttctgcgtcactcacgctgggagctgtagactggagctgttcctattcggccatcttggaacctcctctgcctatagttctttaaaaaaaaaaatttcaggcagggcatgttggctcatgcctgtaataccagtgtagcaggacaagctgcatacaaaacccctcagacaccgagttaaagaaggaagggctttattcagtcaggagctacagcaagactcacgtctccaaaaactgagctccccgagtgagcaattcctgtccttttaagggcttaaaactctaaacaggtccacgtgagggggtcgtgatcgattgagcaagcaggaggtacgtgactgagggctgcatgcaccagtaaacagaacggaacagaacaggacagagattttcacaatgcttttccataccatgtctggaatctatacataacataactggttaggtcatgagttgatctttaaccagacccagggtgcagcacagcccgtggatttaatttctgccttttagtttttacttctttctttggaggcagaaattgggcataagacaacatgaggggtggtctcctcccttaccagcactttggaaggctgaggcaggtggatcacctgaggtcaggagtttgagacgagcctggccgatatggtgaaactctgtctctactaaaaataaaaaatattaaaaaaagttagccaagcgtggtggcgtgtgcatctgtaatcccagctactcgggaggctgaggcagaagaatcacttgaacctgggaggcagaggttgcagtgagctgggatcttgccactgcactccagcctggatgacagggcgagacttcatctcaattaaaaaaaaaatttcaagttttagatttggggtacatgtataggcttgttacatgcatacattgcatgttgctgaggtttgggctgcagatcccatcacccaggtagtgagcatagtacctgtggtggtttttcttttttctttttcttttcttttctctctctttttttttttttagagacagggtctcactatgttgcccaggctggttttgaacacctgagctcaagcaacgttgcccaggctggttttgaactcctgagctcaagcaatcctcctgccttggcctcccaaaatgctgagattacaggtgtgaaccactgcgcctggcccaataggtggttttccaacccacacctcctgctcctccatctggtagtctgcagtatctatcattcccatctttatgtctatgtatacccagtgtttagctcccacttataagtgagaacatgcagtatttgattttctgttcctgtgccaattcacttaggattatagcctccagctgcatccatgttgccgcaaaggatgtgattcatttttttttttatggtggcgtagtatttgatggtgtatatgtaccacattttcttttccaatccaccactgatagacacctaggttgattccatgtctttctattgtgaatagtgctgtgatgaacatacgagcatgtatctttttgatagaacagcttattttcttttggatatatggccagtaatgagattgctgggctgaatagtagccctgttttatattctttgagaaatcttcaacctgctttccacagtggctggactaatttacattcccaccagccaacaatgtataagcgttcctttttcttcattgccttaccagcatctgttattgtctttttaataatagcattctgactggtgtgagatggtatctcattgtggtttatgatttgcatttctctggtgattagtgataatgaactttctttttcaaatgttttttggctacttgtatgtcttcctttgagaagtgtctgtttatgtcctttacccactttttaatggggttatttgtttcttgcttgttgatttgttgaagttccttatagattctggatttcagacctttgtcagatgtggtttgcaaatattttctcccattctgaaagttttctgtttactctgttgatagtttcttttgctctacagaaactctttaattagttcccacttgttgatttttgtttttgttgcagttgcttttgagggcttagccgaaagttctttgccaaggctgctgttgagaaagtatttcctaggttttcttcaatgattttaatagttcgagggctcacatttaaatctttaatccatgtgatttaagtctttaatcacatttaaatctttaatacaccttgagttgatttttgtataaggtgtaaggaaggggttcagtttcattcttctgcatatggatagccagttatctccacactctttattgaatagggagttctttccccattgcttgcttcatagtctttattgaagatcaggtggttataggtgggtggctttatttctgggctctctgttctattccgttggtctatgtgtctgtctttgtaccagtaccatactgttttggttactatagcctcatattcggatagtgtgatgcctccagctttgttatttttgcttaggattgcttttgctatttaggctctttttttgttccgtattaattttagaatagttttttctatctgtgaacaatggcattggtagtttgatacaaatagcattgaatctgcaaattgctttgagcagtgtggccattttaacaatattgattcttccaatccatgagcatggaatacttttccgcttatttgtgtcgtctctgatttctttcaacagtgtatttctctttgtagagaccttttacctccttggttagctgtgttcccaggtacttcatttttcgtttctgcctgtagttctgtgtgtttttaaaatttttgtcggtggttctctttgacttgtaattaatgcattgtatggggatgaaaccagtttctcctgatacctgaacagcttgtcataattctttgccaatagtcaaattcttcacgtggtctctctaaacacatactggccattgatggtgtcaatgcctgacatgtataagggatggggtggggaaaaaagtgtagaggaattacgggaagtcaagtgtggattggatgccacttctctgttttcggtgtgtggtcaggaccacatgaggaaggctggctggtcaactcccccaccccacacaagtacacgcacattaccatcaagggtgatagatgcttaaagtgggacagtctgggagttatgagagcaaatgggaggggcacccacagaaaggcagtatggaagccttcctggtggaagtggcagctaagccaaggcctgaggtggaagcacaagagaagtgaaaaggggtgtggggaagcaaggggccagaggagggagagagaatggaatggagggtcagaatatgcgtatagggtggtgggaggagtggtgggagaaaacaggaaagaagggtaggtgtggcttatcccagacatgcagggcttgttcaatatcccaaataccaatattgcagaaatggacaagctgatcctgaagtccatatggaaacagaagggacccatatattagacttatacctaaatgtttcatgacctttggcactattgtaaattgtactggtttttaaatttaaatttccaattgttggaacagaacagagccctcagaaataattccacatgtctacaaccatctgatctttgacaaacctgacaaaaacaagaaatggggaaaggattccctatttaataaatggtgctgggaaaactggctagccatatgtagaaagctgaaactggatcgcttccttacaccttatacaaaaattaattcaagatggattaaaagcttatatgttagacctaaaaccataaaaaccctagaaggaaacctaggcattaccattcaggacataagcatggtcaaggacttcatgtctaaaacaccaaaagcaatggcaacaaaagccaaaattgacaaatgggatctaattaaactaaggagcttctgcacagcaaaagaaactaccatcagagtgaacaggcaacctacagaatgggagaaaatttttgcaatctactcatctgacaaagggctaatatccagaatcatcaaagaactcaaacaaatttacaagaaaaaaacaaccccatcaacaagtgggtgaaggatattaacagacatttctcaaaagaagacatttatgcagccaacagacacatgaaaaaatgctcatcatcactggccatcagagaaatgcaaatcaaaatcacaatgagataccatctcacaccagttagaatggtgatcattaaaaagtcaggaaacaacacgtgctggagaggatgtggagaaataggaacacttttacactgttggtgggactgtaaactagttcaaccattgtggaagacagtgtggcgattcctcaaggatctagaactagaaataccatttgacccagccatcccattactgggtatatacccaaatgactataaatcatgctgctataaaggcacatgcacacgaatgtttattgcggctctattcacaatagcaaagacttggaaccaacccaaatgtccatcaacgatagactggattaagaaaatgtggcacatatacaccatggaatactatgcagccataaaaaaggatgagttcatgtcttttgtagggacatggatgaagctggaaaccatcattctcagcaaactatcgcaagaacaaaaaaaccaaacactgcatgttctcactcataggtgggaattgaacaatgagaacacttggacacaggaaggggaacatcacacaccagggcctgttgtggggtgggggaagggaggagggaaagcattaggagatatacctaatgtaaatgacaagttaatggatgcagcacaccaacatgacacatgtatacatatgtaacaaacctgcacgttgtgcacatgtaccctagaacttaaagtataataaaaaaataaatttccgattgtttagggatatagaaatacaactggccgggcccagtggctcacgcctgtaatcccagcactttgggaggccgaggcaggtggatcacctgaggtcaggagtttgagatcagcctgaccaacatggagaaaccctgtcgttactaaaaatacaaaattagccaggtgtggtggcacatggctgtaatctcagctacttgggaggctgaggcaggagaatcgcttgaatctgggaggcagaggttatggtgagccgagatcatgccattgcactccagcctgggcaacaagtgtgaaactccatccaaaaaaaaaaaaaaaaaaaaagaaatacaactgattcttacatattgatcttgtatccaaaacaatcttagaaaaggggaacaaagctggagggttcacactttccaattcaaaacttacaaagccatcaagccagaaagtaaattagtggtttccaggggctgggggttggactggggattggaaatactgctaacaggtagagaatttctttctgggaagatggaaatgttctggaggtagtggtgatgattacacaacattgtgaaggtactaaaacccagtgaaccttatactttaaaatggtaaattttatggtctatacatttaatctaaattataaaagctactttgaagaaaacaatgtgattcaccataacagcagattaaagaagaaaaaacatgtaaccacctgaacagatatagaactctaatttgacaacatacaacatcgtttcatgattaaaaatactctcagccgactaggaactaaagggaacttcctcaagctgaaaaagagcatttacaaaaaatctctaccaggcattatacttaaaagtgaaagagaatgcttttcacctaaaattggaaacaagacaagaatatctacttttataattcctatccaacattgtactgaaagacctagccaatgcaataaagcaggaaaaagaagaaaaaaaaatataaagaggaaaggaagaaataaaaccctctctatttgcagatgatacaattgcatggaaaattccaaagaacctataaaaaagctatgataataggttttttcagtaagttctcaggatataggagcaatgtataaaaattagttttatttctataatataattgaacaattggaaatttaaattaaaaagtaccatttacaatagcataaaataccatgaaatatttaggtataaatcaaacgaatcatgtacggtaactttatgctgaaaactacaaaacactaatgagagaaataaaagacctaaataaatggagagagacgctgtggtcatggattcgaatattatagttccaatattgttaagatgtcaattctccctgggttgatctacagattcaatgcagtaaaaatcctggataatattccattgtgcacatgtaccacattttctttatccattcatctgttgatggacacttaagttgattctatatctcgactattgtgaatagtgctgcgataaacacgggagtgcagttatctcttcagtatactgatttcctttcctttggcaatatacccagcactgggattgctggatcatgtggtagttccatttttagttttcttgaggagcctccatattgttctctatagtggctttactaatttacattcctactaacagtgcatgagggttcctctttctctgcatctttgccagcatccatcattgtttgtcttttcgataaaagcccttttaactggaatgagatgatatctcattgtggttttcatttgcatttttctggtacacaaaggaatattattcagccataagatgaatgaatcttgtgatttgcaataacaggattggaactggaggacattatgttaagtaaaacaacccgggcacagaaaaacaaatattgcatgttctcattcatgtgtaggagctaaaaaaaaatggatctcatggaggtagagagtagcatgatgggttactagagactgggaagggtagtaaggaggatggggtaaagaggggatggttaatgggtacaaaaatacagttaggaaaaataagacctagtgtttggtagcacagtagggtgactatagttaacaataatttattgtgtatttcaaaataactacaggaatggaattggaatgttcccagcaaaagaaatgataaatccttgaggcaacggatatcccagttaccctgatttgatcatcacacattgtatgcttgtataaaaatatcacatgttccctataaatatgtgcaattattacatattcataaaaaggtaaaaatcctagaagtatattttgcagaatttagccaattctaaaatttatataaaaaataaaaaagtagagtatccaaaagaattttgaaaagaatcttgatacataccattaagtagctgtcactttttatttatttatttaatttaaaaaaattagattgatattttataatttttcaacttttactttaggtttgagggtacacatgaaagtttgttatataagtaaactcatgtcatgggagtttgttgtacagagtattttgtcacccaggtattaagcctagtatccaatggttattttttctgctcctgcctcctcccaacctccaccctcaagtagaccccagtgtctgttgtttccttctttgtgttcataagttctttatagtttagctcccactaataagtgagaacatgcagtatttgtttttctgttcttgtgttagtttgctaaggataacggccttcagctccatccatgttcccacaaaagacatgatcttgctatttttatggctgcatagtattccacggtgtatatgtaccacattttaaaaaatcctatttgttattggtgggcatttaggttgattccatgttttgctattgtgactagtactgcaataaatattcatgtgcatgtgtctttatggtaggatgatatatattactctgggtatatccccagtaatggggttgctgggttgaatggtagttctgcttttagctctttgaggagttgccatactgctttccccaagtggttaaactaatttaccactcccaccaacagtataagtgttcccttttcttcacaacctcaccagcatctattttttaacttttactaatagccattctaactggtgtgagatggtatctcattgtggttttgatttacatttctctaatgataatgattttgagctttttttgtatgcttgttggctgcatgcatgtcttctttcgaaaagtgtctgttcatttccttttcccaccttttaatggcgttgtttttctcttgtaaatttgtttaagtaccctgtagatgttggatattacacctttgttggatgcatagtttgtgaatattttctctcattctttaggttgtctgttcactctgttgatagtttcttttgctcttgcatttaattagatgccatttgtcaatttttgcttttgttgagattgctttttgtgtctttgtcaggaaatctttgcttattcctgtgtctagaatggtattgcctaggttgtcttccagggttcttatagttttgggttttacatttaagtctttagtctatcttgagttgatttttgtatatggtgtaaggaaggggtccagtttcaatcttctgcatatggctagccagttatcctagcaccatttgttgaataggaattcttttccccattgcttatttttgtcttagatcagatggtcataggtgtatggccttatttctgggctctctattctgttccattggtctatgtgcctgtttttgtaccagtatcatgctgttttggttactgtagccctgtagtatagtttgaagtcaggtaatgtgatgcctccttctgtgttctttttgcttaggattgacttggttattcaggttcttttttgattccatatgaattttaaaatagtttttcctagttctgtgaagaatgtcattggtagcttaatagtaatagcactgaatctataaattgctttgggaagtgtgtccattttaatgatattgattcttcctatccatgagcatgagatgttttaccatttttttggtgtcatctctgatttctttgaacagtgttttacaattctcactgtacagatctttcaactctctggttagctgtattcctagttattttattctttttgtggcaatcgtgaataggattgccttcctgatttggctcccagctcttgttggtgtataggagtgctagtgatttttgtacattgatttcgtatcctgaaactttgttgaagttatttatcagctgaaggagctcctaggccaagactatggggttttctaaatatagaatcatgttgtctgcaaacagggatagtttgacttttttacttcctttcttcctatttgtatgcccttttttctttcttttgcctgattgctctggctagaacttccaataatatgttgaataggactagtgagcaaaggcatccttgttttgtgctggctttcaaggggaatgcttttgcccatcaagtatgatgttggctgtgggtttgttgtagatggctcttattattttgaggtatgttccttcaatacctagtttattgagaatttttaacataaaggggtgttgacttttattaaagccttctcttcatctattgagataatcatgtggtttttgtctttagttctgtttatgtgatgaatcatatttattgatttgcatatgttgaaccaactttgcaccccgggaatgaagcctacctgatcatggtggattagatttttgatgtgctgctggatttggtttgcaggtagtgtgttgaggatttttgcattagtgttcatcaagaatattggcctgaaattttctttttttgttaagctgacactttttagtttgatgccaccccatttgtctggtttgcttttgttgcctgtgcttttggggtcatatccaaaaaatcatttctcagaagcttgattgtcaagaagcttttccctttgttttcttctagtagttttacagtttcaggtcttgtgtttaagtctttaatccattttgagttgattttgtatatggtttgggataaaggtctaatttaatccttttgaatatgaatatccagttctccccacaccatttgttgaagagaatgtcctttctcctttgcatattcttggcacctttattgaagatcaattgaccataaatgcatagttttatttctagcctccctgttctgttccattggttgatgtgtctgtttttatgccaccaccttgctgttatgcttactagagctttcttgacacagtatgttttgagatcaggaattatgatgcctccagtattttttttcttgaggattgctttggctatttagggtcttctgtggttctacataaattttagttttttttctatttttgtaaaaaaatgccattgggattttgataaggattgtactgaatcagaagattgcattaatactccagtccatgaacataggatatctttccatttatttttgtcttgtttaacttccttaatcaatgttttatagttttagtgtacatgtttttcacctctctggttaaatttaagcttaggtattttttttgatgctattgtaaatgagattgtttcttgatttctttttcagatagttcattgttagtgtatagaagcactattgatttttcacattgattttgtaacctgtaactttactgaatttattcattagttctagtagttcttttttggtggagtttttagggttttttaaaaatatatttatatatatatgtttttatatatatatcattttaagtgtaaacagagacaaatttccttttttatatctgatttgggtctctttcatttatttttcttgcctaattgctgtgaccaggacttccagtactatgttacatagaagtagtgagagtgagcattcttgcctttttcctcattttagtggtaaagctttcaatttttcaccattgagtatgatgtttgttgtgggcttgtcgtatatggcctttatcatattgaggtacattccttctgtagcgaatttattgagagtttttattataaaagaatgttgaattttgtcaaatgcttttttttgcgtatattgagatgatcatgtggttttagtccttcattctgttaatgtgatatgccacattaattgatttgcatatgtggaatcatccttgcatctcgcatcccagggataaatcacacttgatcatggttattatctttttatcttttttttttttttttttaacagagtctctctgtgttgcccaggctggagtgcagtggcgttatctcggctcactgcaagctccacctcccaggttcacgccattctcctgcctcagcctcttgagtagctgggactataggcgcccgccaccatgccctgctaatttttttttttttgtatttttagtagagatggggtttcaccatgatttccaggttggtctcgaactcctgacctcaggtgatccacacgccctggcctcccaaaatgctgggattacaggcatgagccactgcatctggccggttatatgactttatatgtttgtcaaaactcataaaactatgtactaaaaggctgaattttattgtatgtaaactcttccccaataaatctgacctaaaaaacaatcaaattctgttgactttaggataaagtattcagttatcaatgagtcttccctcaatggtgtatgaggcagaaatcacgttgcagagccgtggcatgatgtcccctgcacattccctttctagaacttgtcccagtttgaaattgctatacacatctccctgttaatccattgattactctcctctcctccacctggctgcactgagggccctggaaggcactgtatctctattacccagctgtgtgcttagcaataagaaacacttgtttgttgaatgaatgaataaatgaatgaatgaatgtatgattaaataggtgaattttatggatgaattctacatattgaccttgaagatatttcttaatatcacaacaaatattcaaataacaaatagttatttttaatctaagccagttattagccttattagtcagagtgccaactttgactttttacctccctaaagattcccaatatattgaaagggtggtattctgtcttctcttctagaattttctatgtattttccaacccaaattcttctttgctgccttaataatctcccaggaataccacctggagtaaatcctcactcactgcccattgactctactataggcttattttttatcttttaaattattaaaaaatatatatatacacttagagattgggatcttgctctgttgcccaagctggagtgcagtggtgacaaagctcactgcagccttaaactccttggctcaagggatcctcccacttcagccccccgaggagctgggattacaggcagaaaccattctgccaggcttattatataggttcctttagctggcagcacattcaagtgataatttatcatgaaccatatagaagatcacatctgctccagagggattcccccagcaggcataacttttcttcagagagagaaaacctccacatctgctttaggtgggaagaggtgtgtgattacggtcctgtctctttcagatcggcgcctacttcggggcctccctctgctccgtggacgtggacagcaacggcagcaccgacctggtcctcatcggggccccccattactacgagcagacccgagggggccaggtgtccgtgtgccccttgcccaggggggtgagtggcaatgggacctgggctgggtggggcccggtgtgggtggaggggtcgcctgggttggggcctgatactgtttgtgtttagcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccaggtgagacctggtcactgtccttgtcatgacagtagcctctttgttgatctttctcctaattcagtgtgcccacagctgccagataagttctcacagtactcctttcagaaccttcaaaaataataacatgtggctgggcctggtggctgacgcctgtaatcccagcactttggaaggctgagttgggaggattgtttaagcccaggagctcaagaccagtcagggcaacatggtgagaacccatctctccaaaaaaaaaaaaaaaaaaaaaaaattagccaggtgtggtggcatacacccatggtcccagctactctggaggctgaggccggaggattacttgagcctgggaggttgaggctgcagtgagtcctggtcacaccactgtactccagcagccagagtgacagagtcagacttgcacatgcatgcgtgcacgtgcacacacacacacacattcacagaaatctcaaagactcttagttccagattgattatttctacagcaataggaggtgcatgatagcctcatcacccccactttacagatgagtagatcaaggcccagcgatggcaaatggcaagctagcagtattgggatgcaggcattcctttcttctgaatctcggtcctggtaaggtgaccaagagctctagtttgcttaactctgtcccagatttagtactgaaatcccacatcctgggaaacctatgcggttggccaccttacgggattgcacacttcacagatgtggaattgtgcagtcacacgtgcccctctctcagaatcgccctgtgcttggcttaatgctctgctattgccatcttcaattcttagtaatttttcaacaaggggtcctacgtttttttgcattgggtcttgcaaagcatggagcccatcctgatgacttgtcaccctatattctggacctgacaactgttttgctctgtaagttggctttctgtctcctgccaggtggagcccactgtctggagggacccttacagtctggttccatcttccctgttcatattctttcccaccatagccacctgagaccatctagttttctggcctctggtctctgggtttttgctagccttacatttttctttctttatgtttaaaaatttttttattgtggtaagggcacttaacatgagacctatcctcttaacagattttaaaatgtacaatgtaatactgtcatctattggtgcaatgttgtacagcagacctcttgaacttcatcttgcatattgaaaatgtatacccattgattagcaactcctcattgttctctagcctctggcagccaccattatattctttgcttcaatgagtttggctgttttatttttttttagtttttgagacaaaagtttcagtctgtcgcccaggctggagtgcagtggcacaatctcggctcactgcaaccttacctcctgggttcaagcgattctcctctctcagcctcctgagtagctgggattacaagcatgcaccaccatgcctggctaatttttgtattttttgtagagactgggttttgccatgttgtccaggctggtcttgagctcccggactcaagtgatccacctgccttggcctcccaaagtgctgggattacaggtgtgagccaccgcaccctgccagtttggctattttagataactcatataagtgaaaccacgccgtattcatcctttggtgactggcttatttcacttagaataacgtcctccaggttcatccatgttgtcacaaatgaaagaatatctttcttctttttcttctcctcctcctcctcttcctcctcctcctcctccgcctccccctcctcctcctcttcctcctcctccccctcctccccctcctcgtcgtcctcctctcctcctcctcctcctcctccttcttcttttttgacaaagtcttgttctgtcacacaggctggagtgcagtggtgcaaacacggctcctggaagcctcaacctcctgggctcaagcgaccctcccacctcagtctcctgagtagctgggactgtgggcccattccaccatgcctgtctaatttatttttattttttgtagagatggggtctccctatgttgcccaggctgatggctttcttttttaaggctgaataatatcccactgtatgtatataccacaattaaaaaaatccatcatttcctggtagagagggaaggaaaaatccctcatctgttgataggcatttaggttgttttcacatcctggctattgtgaatagtgctgcaatgaacatgggcacgttcatatctctttaagatcataatccccattcctctggttaaataaccagaagtgggattattaaatcatatggtagttctatttctaattttttgaggaacttccatacgttttccctaggagctgcaccattttgcagtctcgccaacagtgtgcaaaggttctgatttttccatgtgtttaccaacacttgtcttttgtttttttggcaatagccaggctagcaggtgtgcaagtgaaatttcactgtggctttgatttgcatttccctgatgattagtgatgttgagcatcttttcatgtatgtattgggcatttttgtgtctgaaaaaaatgtctcttcaagcccttaagcttatttttaaatcaagttattaaggccgggagcagcggctcatgcctgtaatcccagcacattgggaagccgaggcgggtgtatcacctgaggtcaggagttcaagaccagcctggccaacagggtaaaacttcatctctactaaaaatacaaaaattagccgggctgtggtggtgcatgcctgtaatcccagctattccagaggctgagatgggagaatcgcttgaacccgggaggtggaggttgcagtgagccgagattgtgccactgcactccagcctgggagacagagggagaccttgtctcaaaaaaagagaaaagttattagattttttgctattgagttgtatgagttcactatatattttggagattaaccccttatcagatacatggtttgcaaatactctctcccattccataggttatattttactctgcttattcttgcctttgctgtgtagaagtctcacttggtttgatgcagtcaggcttagttatttttgtcgtctgtacttttggtgtcatagccataaactcattgctcaaaccaccatctttccagcttctcccctgagttttattctagatgttttactttttcattgaagtctttaattcattttgaattgatttttgtgtatggtatatgagtcaagttgcattctcctgcatttgtatatccagtttcccaataccatttgtctaagagagtatcctttacccattgtgtattcttggcattatttaggagaatcagttggacccatatggatgggtttatttctgggctctgtattctgttccatttgtctatatgtctatctttatgctagtaccatactattttaagtactataactttgtcatttatatatataatcctgcattttattagagtcaaataacattaaaagaaagacacttatattcgctttagaaaacccattgatgttgatgaatttggcacatacttataaaagcaaggcttattagctcatatatttggaactaaaaagtatttgaagttgatcacagcataatgaatcctcaatttccagagtactagagatgattatatacaaaaatccagtgaaacttattttactaatttaccagttctatatcactcctaaatttccctaaaaatatggatttataaaaggtagtattctataattcacaaatatgaagagctttattataatttgagtatgaactgtgtatcacccatatcatggcttcagaaaactattgcttttcttactaacttatttaaggtttcactacatgagtcagtatgcagaactcactatgttgtaactacgatctgtaatgataaaaatatagaacctctttgactttaatctaaaaaagtcaccttatcataaaacagtgttaacataatcaaaaattaaccctgacaaaaaaaaacccacttattttggcttttaaaaatagctcatgctcatggttctttcaaagtggtgttgtagctaccgtcttttctaacagaggaatattttcatcatagcaactatttctgagccaaaaataaaccacactaaaaacagaagaaaattctcagtgtagaaaggaaaaggctcatctgttgtgcaatagcaggcatcgggctctgtgagtgcctttcagacatcctcaatcaacccaactagaggcactattgagtttatccagtaagagcactgtgcaatctagtgctgtgagggcattacttaattagccaaaggaagaacaatctttttttctttcttttcttttcttttttcttttcttttcttttttctttctttctttctttcttctttctttctttctttctttcttccttcctttctttctttctttctttctttcttttttctttccttctttctttctttcttttttttctttctctttctcttttgtttttgtttttgttttgagacggagtctcgtgctgttgcccaggatggagtgcagtggagtgagctcggctcactgcaacctccgcatcccaggttcaagctattctcttgcctcagcctgccgagtagctgagatgacaggcgcccgccactacgcctggctaatatttttctctttttaggagagacggggtttcaccatgttggccaggctggtctcgaacacctgaccttgtgattcacctgcctcagcctcccaaagtgctgggattacaggcgtgagccaccgcgcccagctttttctttctctttctttcttctttctttctctctctctctttccctccctctttctttctttctctctctctctttccctccctctttctttctttctttctttctttctttctttctttctttctttctttctttctttctttctttctttctttctttctttttctttctctctttctttctctctgtttctttctctctctttttatttttttgagacaaggtctccctctgttgcccaggctggagtgcagtgacgagatcatggctcactgcagtcttgacacccaggctcaagcaattcttccttctcagctgcccaagtagctgagactataggtgtgcacccccacgcttggctaatttttcaattttttgtagagatgaagtctcactatgttggccaggctggtcttctggcctcaagccatcctcctgccttggcctctcaaagtgttaggattatagatgtgagccactgcacccagccaaagcagtcttcaagttatgtaccagtaatttatatagcttttctaaaatttaagaaagtactgaatggactatagttattatctaaaatttaagcaagtactgagtggactatagtcattatatgattttttaaaaaatttcagtaacttttggggtacaagtgctttttggttacatgaatgaattctatagtggtgaattctgagattttagtgcacctgtcatcaaagcagcgtacactgtaccaaatatatagtcttttgtctcttacctcctcccagactccccttccccaagtcctcaaagtccgttacatcactcttgtctttgcatccttatagtttagctcccacttataaatgaaaacatatatttagttttccattcctgtgttacttcagtaatggcctccagttctatccaagttgctgcaaaatacattatttgttcctttttatggctgggtagtactctgtgtatatatacacatatacacacacacatatatataactttttaaaatccactcattggtcgacgggtaccacagtttggttccatatctttgcaattgtgaattgtgctgctataaacatgcatgttcatgtatctttttcatataatgacttcttttcctttgggtagatacccagtagtgggattactgaatcaaatggtagatctactattagttatttaaggaatctccatactgttttccatagaggttgtgctaatttacattcccaccagcagtgtaaaagtgtccccttttcatcacatccatgccagatctattgttttttgactttttagttatggccattcttgcaggagtaaggtggtattttattgtggttttaatttgcatttccttgatgattagtgatgttgagcatttttttcatatgtttatcggccatttgtatatcttcttttgagaattgtctattcatatcctttgcctactttttgatgggattatttgttttttccttgctgatttgtttgagttccttatagtttctggatagtagtcctttgtcagatgcatagttggcaaatattttcttgcattctgtgggttttctgtttgctctgatgattatttcttttgctgtgcagaagctttttagtttaattaggtcccatttattggttttgttgcatttgcttttggggtcttggtcatgaattctttgcctaggccaatgtccagaagagtttttccaatgttatcttgtagaattgttatggtttcaggtcttagatttcagtctttgatccatcttgagttgatttttgtataagttgagagaagaagatccagtttcattcttctacatgtgatttgcctgttttcccagcgccatttactgaatagggtgtccttttcccaatttatgtttttgtatgctttgtaaaagatcagttggctgtaagtatttggttttatttctgggttctttgttttgttccattggtctaagtgcctatttttataccagtaccatgctgttttggtaactatagccttgtagtataatttgaagtctggtactgtgatgcctccagatttgttctttttgcttagtattgctttggctatttgggctctttttttttgttccatatgagttttaggattgttttattctagttatgtgaaaaatgatgttggtattttgatgggaattgcattaaatctgtagattgggcagtatggtcattttcacaatattgattcttcctatccatgagcatgggatatatttccatttgtttgtgtcatctataatttatttcagcagtgttttgtagttttccttgtagggagcttcacctccttggttaactatattcctaggcattttattttatttttgtagctgttataaaaggggttgagttcttgatttgattctcagctttgtcattgttggtgtatagcagtgctactgatttgcatacattgattttgtaacctgagactactgaaattgtttatcagatctaggaatcttttggatgagcctttagcattttctaggtaaatgatcatatcattggcaaacagctctaatttgacttcctcttttccaatttggacccctttatttctttctcttgactgatttgatttggctgggactttcagtactgtgttgaatagaagtgctgaaagtgggcattcttgtcttgttccagttcttagtgagaatgctttcaacttttcccccttcaatatgaagttggctgtgcttttgtcagataatggcttttattattttgagataagtcccttctatgtctaatttattgaaagcctttttttaatcataaagggatgctggattttatcaaatgcttgttctgcatctattgagatgattatatagttttcttctttaattctgtttatgtgatgtatcacatttattgacttgcatatattaaaccattcctgcgtccttgggatgaaacagacttgatcatgatgtattatctttttgatgtactgttggatttggttagctagtattttgttaaggatttttgcttctatattcatcagggatattgttctgtagttttcttttttttgttatatccttttctggttttgatattagtgtgatactggctttatagaatgatttagggaggattccctctttctctatcttttggaatagtatcatatcattggtaccaattctttgaatgtctgttaaaattcagctgtgaaaccttctggtcctgggctctttctgatttgatctcgctgcttgttattggtctgttcttggtatctatttcttgctatagctattatatgattaatccaaggtaccgaaaagcattttgaatgatttagcaggccatcctttttccttgtgtcctaatgaggaatttttttgacgcttcataattctcttaacaaggaattttagctcctcctccatcattttgtaaaataacgatgataatttaaaacttccatcaacatattaaattttcaaaattaaacaactaaaagctacaaaaatctcaaagtttgagttttaaactgaatatttgaagctaatatagaaatttttgataagaatatcagtgcagacatataacactcaaaccttcacagctaatggcaatatctattagcaatgcaaggtactctttttttttttttttctttttgagatggagaattttgccctgttgcccacactggagtacagtggcatgatcttggcttactgcaacctctgcctcctgggcaagagattcttttgcctcagcctcctgagtagctgggattacaggagtgcgccaccatgcccagctaatttttgtatttttagtagagattgggtttcaccatgttggccagtctggtctcgaactactgaccttgtgatctgcccgtctcagcatcccaaagtgctgggattacaggcatgagccaccatgtctggccgcaaagtactcttaatgacttttaaatcatgtttaacagagagtttacacaagttagtccaatgtagttagtattagtgtccaataatatatgaacacccttcaagacaattgctgctacattttcaatataattattaattgttgtctgaaaaacacacataaacgcaagtgagactaaaagttgtgtcacaaaagaaaaaaagaaaagaccagtaccatgctgttttggttactgtagcctggtagtatggtttgaagtcaggtagcgtgatgcctctagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccacgagcatggaatgttcttccatttgtttgtatcctcttttatttcattgagcagtggtttgtagttctccttcaagaggtccttcacatcccttgtaagttggattcctatatattttgttctctttgaagcaattgtgaatggaagtgcactcatgatttggctctctgtttgtctgttactggtgtgtaagaatgcttgtgatttttgcacattgattttgtatcctgagactttgctgaagttgcttatcagcttaaggagattttgggctgagacgatggggttttctagatatacagtcatgtcatctgcaaacagggacaatttgacttcctcttttcctaatcgaatgccctttattcccttctgctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcctatcagtacctaatttatggagagtttttagcatgaagggttgttgaattttgtcaaaggccttttctgcatctattgagataatcatgcggttttcgtctttggttctgtttatatgctggattacgtttattgattttcgtatgttgaaccagccttgcatcccagggatgaagcccacttgatcatggtggataagctttttgatgtgttgctggattcggtttgccagtattttattgaggatttttgcataaatgttcatcaaggatattggtctaaaattctctttttttgttgtgtgtctgccaggctttggtctcaggatgatgctggccttataaaatgagttagggaggattccctctttttctattgattggaagagtttcagaaggaatggtaccatctcctccttgtacctctggtagaattcggctgtgaatccatctggtcctggacttttttttggttggtaagctattagttattgcctcaatttcagagtctgttattggtctattcagagattcagcttcttcctggtttagtcttgggagagtgtatgtgtcgaggaatttatccatttcttctagattttctagtttatttgcgtagaggtgtttgtagtatcctctgatggtagtttgtatttctgtgagataggtggtgatatcccctttgtcatttttgtattgcatctatttgattcttctctcttttcttctttattagtcttgctagggctctatcaattttgctgatcttttcaaaaaaaccagctcctggattcactaattttttgaagggttttttgtgtctctatttccttcagttctgctctaatcttagttatttcttgccttctgctagcttttgaatgtgtttgctcttgcttctctagttcttttaattgcgatgttagggtgtcaattttagatctttcctgctttctcttatgggcatttagtgctataaatttccctctacacactactttgaatgtgtcccagagattttggtatgttgtgtctttgttctcattggtttcaaagaacatctttatttctgccttcattttgttatgtacccagtagtccttcaggagcaggttgttcagtttccatgtagttgagcggttttgagtgagtttcttcaccctgagttctagtttgattgcactgtggtccgagagacagtttgttataatttctgttcttttacatttgctgaggagtgctttacttccaactatgtggtcagttttggaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagttcttcttgttgaattgatccctttaccattatgtaatggccttctttgtctcttttgatctttgttggtttaaagactgttttacccgagactaggattgcaacccctgcctttttttgttttccatttgcttggtagatcttcctccatccctttattttgagcctatgtgtgtctctgcacttgagatgggtttcctgaatacagcacactgatgggtcttgactctttatccaatttgccagtctgtgccttttaattggaacattaagcccatttacatttaaggttagtatttttatgtgtgaattagatcctgtcattatgatgttagctggttattttgctcgttagttgatgcagtttcttcttagccttgatggtctttacagtttggcatgtttttgcagtggctggtaccggctgttcctttccatgtttagtgcttccttcaggagctcttttagggcaggcctggtggtgacaaaatctctcagcatttgtttgtctgtaaagtattttatttcttcttcacttatgaagcttagtttggctggatatgaaattctgggttgaaaattctttcctttaagaatgttgaatattggcccccactctcttctggcttgtagagtttctgctgagagagaaagttcgggttacccacaaagggaagcccatcagactagatcagctgccagtctgatgggcttccctttgtgggtaacccaacctttctctctggctgcccttaacattttttccttcatttcaactttggtgaatctgacaattatgtgttttggagttgctcttctcgaggagtatctttgtggcgttctctgtatttcctgaatttgaatgttggcctgccttgctagattggggaagttctcctggataatatcctgcagagtgttttccaacttgattccattctccccgtcactttcaggtacaccaatgagatgtagatttggtcttttcacatagtcccatatttcttggaggctttgttcatttctttttattcttttttctctaaacttctcttcacgcttcatttcattcatttcgtcttccatcgctgataccctttcttccagttgatcgcgtcagttactgaggcttgtgcattcgtcacgtagttctcgtgccgtggttttcagctccatcaggtcctttaaggacttctccgcattgattattctagttatccattcgtctaattttttttcaaagtttttaacttctttgccattggtttgaacttcctcctttagctcagagtagtttgatcttctgaagccttcctctctcaactcgtcaaagtgattctccgtccagctttgttccgttgctggtgaggagctgcgttcctttgtaggaggagaggcgctctgatttttagagtttccggtttttctgctctgttttttccccatctttgtggttttatctacctttggtctttgatgatggtgacgtacagatgggtttttggtgtggatgtcctttctgttgttagttttccttctaacagtcaggaccttcagctgctggagatatagaccaatggaacagaactgagcactcagaaatagtgccgcatatctacaactatctgatctttgacaaacctgacaaaaagaagaaatggggaaaggattccctatttaataaatggtgctgggaaaactggctggccatatgtagaaagctgaaactggatcccttccttacaccgtatacaaaaattaattcaagatggattaaagacttacatgttagtcctaaaaccataaaaaccctagaagaaaacctaggcaataccattgaggacataggcatgggcaaggacttcatgtctaaaacatcgaaagcaatggcaacaaaagccaaaattgacaaatgggatctaattaaactaaagagctgctgcacagcaaaagaaactaccatcagagtgaacaggcaacctactgaatgggagaaaatttttgcaacctactcatctgacaaaggggtaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacagcaggtgttggagaggatgtggagaaataggaacacttttacactgttggtgggactgtaaactagttcaaccattgtggaagtcagtgtggtgattcctcagggatctagaactggaaataccatctgacccagccatcccattactgggtatatacccaaaggattatacatcatgctgctataaaggcacatgcatacaagtgtttattgcggcactattcacaatagcaaagacttggaaccaacccaaatgttcaacaatgatagactggattaagaaagtgtggcacatatacaccatggaacactacgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacaaacctgcacgttgtgcatgtgtaccctaaaacttaaagtattataataataaaaaagaaaaagaaaagaaatccaatgaatcaattaatgctatcaacaaagaacatgcaagaatgtaacattacatgtaatttttgttttcaaaaaagacactaaaatgccactgcattaaaatgtatttattatttattattattatttttgagacagggtcttggtctgtcatgcaggctggagtgaagtggtgcaatcatggctcactgcagccttgacctcccaggctcatgtgatccgcctgcctcagcctcctaagtgtctttgactgcaggtgtatgccaccatacctggctaatatttaaatttcttttgcagtgacagggtctgtctatgtttcccaggctggtctccaactcctgggctcaagtgatcttcccaccttggcctcccaaagtgctgggactactggtgtgagccactgcactcagccggactataatttattcagaacatctttagtgttcattcccagagatcttgatctgctcagtaatgctttcacaagatcgattatagccatcttttgcagtgaatgcttaggctggtccgtcctcctgtggtagtagggagcagtctttttttttttttttttaaatcttcatgtttttatttattttttcttttttaaattacacattgggccaggcacagtggctcatgcctgtaatcccagcactttgggaggccgaggcgggcggatcacgaggtcaggagttcaagaccagccttgccaacatggtgaaaccccatctctactaaaaatacaaaaattagctgggcttggtggcgtgtgcctgtaatcccagctacttgggaggctgaggcaggagaattgcttgaacccaggaggcggaggttgcagtgagccaagactgcaccactgcacgccagcctggcaacagagcgagactccgtctcaaaaaaaaaaattatacgttaagttctgtgatacatgtgcagaacatgtaggtttgttacctaggtatacaagtgccatggtggtttgctgcacccatcaacccgttgtctaggttttaagcctcacatgcattaggtatttgtcctaatgctctccctcccccttgatccccacccctcaacaggctccagtgatgttcccctccctgtgtccatgtattctcattgttcaactcccacttatgagtgagagtatgtggtgtttgctttcctgttcctgtgttagtttgctgagaatgatggtttccagtttcatctatgtccctgcaaaggacatgaactcattctcttttatggctgcatagtattccatggtgtatatgtaccacattttctttatacagtttatcattgatgggcatttaggttggttccaagtctttgctattgtaaatagtgcttcagtaaaaatacatgtgcatgtgtctttatagtagaatgatttataatcctttgggtatatacccagtaatgggattgctgggtcaaatggtatttctggttttagatccttgaggaatcgccacactgtcttctacaatggttgaactgatttacactcccactaacagtgtaaaagcattcttatttctccacatcctctccagcatctgttgtttcctgactttttaatgatcatcattttaactggcatgagatggtatctcattgtggttttgatttgcatttctctaatgaccagtgatgagcttttttttttcatatgtttgttggccacataaatgtcttcttttgagaagtatctgttcatatcctttgcccattttttgatggggttgtttgtttttttcttgtaaatttgtttatgttccttgtagattctggatattagacctttgtcagatggatagattgcaaaaatattctctcattctgtaggctgcctgttcactctgatgatagtttcttttgctgtgcagaagctctttagtttaattagatctcatttgtcaattttggcttttgttgcaattgcttttggtgttttagtaaggaagattttgcccatgcctatgccctgaatggtactgcctaggttttattctagggtttttatggttgtaaattttacatttaagtctttaatccatcttaagttaatttttatataaggtgtaaggaagggatctagtttcagttttttgcatatggctagccagttttcccagaagcatttattaaatagggaatcctttccccatttcctgcttttgtcaggtttgttgaagatcagatggttgtagatgtgtggtgatatttctgaggcctctgttctgtttcatttgtctatatatctgttttggtatcagtaccatgctgttttggttactgtagccttgtagtatagtttgaagtcaggtagtgtgatgcttccagctttgttgttttgcttaggattgtcttggctatatgggctcttttttggctgcatatgaaatttaaagtagttttcacaagatcagctacagccaacttttacagcaaacggttaggctgttcctcctgtggtagtaggaggcagggtttttttttttttttttttgagatggagtctcagtctgtcacccaggctggagtacagtagcgtgaactgcaacctctgcctccaggttcaggtgattctcctgcctcagcctcctgagtagctgggattacaggtgcccaccaccacacccagctaatttttgtatttttagtagagatggcatttcaccatgttggccaggctggtctcaaactcctgatctcaagtgattcacctgcctcagcctcccaaagtgctgggattacaggtgtgagtcaccgaacccggccctctttgcccatttttaaattgggttatttattttcttactattgagttctttatgtgttatggatattaaccatttatcagttgtgtggtttgcaaatattttcccccagtctgtaggttgtctcttcactctgttaattattcctttattgtgcagaagctttttagtttgatgcaattccatttgtctgtttttgtttttgttgcttgtgctttcaggatcatataaaaaaatcattgcccagaccaatgtcatgaagctttccctctacgtttccttctaatagtttatagtgttagatcttacatttaagcctttaactcactttttaatttttttattttttaatttaattttattttagatggagtctctctctattgcccaggctggagtgcagtggcacgatctcagctcactgcaacctccacctcccgggtcccagcgattctcctgcctcagcctcccaagtagctgggattacaggcctccgccaccatgcctggctacttttttgtatatttaatagagacggggtttcaccatgttggccaggctggtcttgaactcctgatctaaggtaatccacccgcctcagtctcctaaagtgctgggattacaggcgtgagccactgcacccggcccagcacttttgatttttgtatttggtttgagataaaggctcagtttcattcttttgcctgtggatatccagtgttcttaacaccatttgttaaaaagactgtcctttccccattgtatgcccttggcacctttgttgaaaattagttgattgttggccgggcgcggtggctcatgcctgtaatctcagcactttggaaggctgaggcgggtggatcatgaggtcaggaaatcgagaccgtcatggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagtcgagattgcgccactgcagtccgcagtccggcctgggcgacagagcgagactccgtctcaaaaaaaaaaaaaaaaaaaaaaaaaaaaaaaaaaaaaattagccaggcatggtggtgggcacctgtagttccagctactcgggaggctgaggcaggagaatgggggaacctgggaggaagaggttgcagtgagcctacatcatgccactgcactccagcctgggtaacagagcaagactccgtctggaaaaaaaaaaaaaagaaaagaaaattagttgattgtaaatgcatgggttcatttctgagctctgtattctgttccattggtcaatgtctctgtttttatgtcagtgtcatgctgttttgctgagtatacctttgtggtgtattttgatgtcaggtagtgtgatacctctacctttgttgtttatgctcaagattgtcttggatatttgaggtcttttgtgacttcatattaattttagtattgttttttctatttctgtaagaaatgccattgggattttggtaggaattacattgactctatcgatcactttgaatagtatggacctttaaaaatattctttcaatccataatatgggatatctttccattgatttttgtcttaactttctttcgtcaatgttttatagttttagtgtgcatatttttcaccttcttggttaaattaacttgtaagcattttattttttgatgccattgtaaataggattaatttctttttcagatagtttgttgttagtgtatagaaacaaataatttttgtatgttcattttgtattccatgactttactaaatttgtttattaaatttgataactttttcgtagagtatttataacaagtttcttatatataagatcatgtcaattgcaaacagggacaatttttttttctttatttctaacttgaatgcatttcttatctttttcttgcccaattgctctggctaggactttcagtactgtgttgaaatagaagtggtgagtgtgggcatccttgccttgttcctaattttagtggtaaaatcaaattttcaccactgggtatgatgttaactagacactttttttaatgttctttatcatgttgatgtaatttccctgtatttctagtttgttgagggtttttaatcatgagtggctattcctgtggcctgaatgtttgtgtcctccccagattcatatgttgaagcctaattccttgtgtgatggtatttgtagatgggacctttggaaggtgtttaggtcatgagagtgtggccatcattaataggattagtgcccttagacaaaagcaaaatgatggttgcctatgaaccagaaaataggctctcaccagatattgaatctgcttgcaccttgattttggatgtcacaagtcttcagaactatgagaaataaatttctattgcttataacccatccagtctatgttatttgttataccaaataagctaagacagatgtttagttttattaaatgctttcttttcttattgataagatcatgttatttttattccttattctgttaatgtggtgcatcacatttattgatttgcatatgttgagccatccttgcatgccaggaataaagcccacatggtcatggcgtatgacccttttgtgctattgaattcagtttgctagtattttatttaggattttggatctatgttcaatagggaaattggcatgtagtgatcttttctcatggtgtgtttgttgggatttagtgtcaggatagtgcttgcctcatacaataagtttggaagtattccctcctcttcagttttttggatgagtttgagaagaattcatattaattcttatttaaatgtttggttggtagaatttgcctgagaagccaccaggtcctgggcttttctttgttaggaggtctttgattactgattcaatttccttactcattatagatctgtttaaactttctattgccttatgattcaggcttggtaggttgtatatttctaggaatttatccattccttcaaggttatcaagtttgttaacatataattgttcatagtagtctcttaatgatcctttttattgctatggcatcagttgtatgttctttcatttataattttacttatctgttgtttctgttttttctccctttttccttggtctacctaaaagcttgtcagttctttttttttttttttttgagatggagtctcactctgttgcccaggctggagtgcagtggcatgatcacagctcactgcattctccacctcccaggttcaagtgattctcctgcctcaggctcctgagtagctggcattacaagcacgtgccaccacacctggctgattttcgtatttttagtagagacagggtttcaccatgatggccaggctggttttgaactcctcatctcaggtgatccacttgcctcgacatcccaaagtgctgggattgcaggcgtgagccactgcacctggccaaagcttgtcaattctatctttttgaaaaatcaacttaatttcattgatttttttctattctctatttgatttatttttctgtaatctttattattttcttccttctactaactttaggtttagtttgttcttttatttctcatttcttgaggtgtaaagttaggttttgtaattgaaatttgtctttttgttttaaaattaggtgtttatcccgaactttcctttagtactgcttttgctgcctcccattaagtttggtatattgtgtttttgttttcatttatctcatgttattttctaatttatttttttatccattagttgttcaatggtgtattgtttaatttttacatatgtatgtttttttccagtttttcttctggtattgtttttagtttcattccattgtggttggaaaagattcttgatataatttaaatcatttcaaatttgttaagacttgttttgtgacctaacatgtggtctgtcctggggaatggtccatgtgcacttgagaagaatgtatattctgcagtagttggcttgtgtattttgtatatgtctgttaagtccatttggtccattctcccttgggttttttttttgtctagttgttctatttgctattgaaagtaggattttgaagtttcttactattgaattgctgtctatttctcccttcagttctgtcattattagctttatatattcagatgtctgatgggtgtgtatataattaattgttgtaactcctggtgaaatggccatttcatcattatataatatcattatttgttttttgacttaaagtctattttgtctgatattagcatgtcatcctgctctcttttggttaccattttaatggaatagcattttctactcctttacttttagcctatgtgtcagtaaatacaaagtgggtatcttgtagatagcatataattggattttgtatttttattaattctgccactctgttttgagagtttgcttctgtttacatttaaagtaattattgatagagaaggatttactactgccattttgttaattgttttctgttagtcatgtaggtcttttgtccctcttttcttctcttgctgtcttcctttgtgttttattgttgttaatttttgtattaatatgctttcattttgttctctttttgtacttttttttttttgagacggaatctcattctgtcacccaggctggagtgcagtggtgcgatctcggctcactgcaagctccgcctcccgggttcaggccattcttctgcctcagcctcccgagtagctgggactacaggtgcccaccacctctcctggctaattttttgtatttttaatagagatggggtttcaccacgttagccaggatggtcttgatctcctgacctcgtgatccgcccacctcagcctcccaaagtgctgggattacaggtgtaagccacgtgagccaccgcgtctgaccctttttttgtgtatataacttctaaaggtattttctttgtggtttccacaaaacatctcataattatcatggtctattttaagctgataacaactgaacttaaatcacatgcactctatacttttattccccactacacgttttacgttattgattcacaatttacagttatttatattgtgtatccagtaacataattttagctatagttatttttaatatctttgtcttataacttttataccataattaaaagtgtccaattcacttgcattaaggacatgacaaaatcacttttaaaatttctttaaaatttattatttggctgtcatttttttcaatattactcttgcacatactttaaagagtcaaaatagttccaaaaagctcactattaaaaaacaacaatttccacatacacgatggttttggcttcatttcccttgctcttgagggaaccactttcagctctttcaattctctatttgttccaattacataataataattttgctactttttgatttttgttttaccactgacttcccaccatggaaggtggagattgatctctttttcagttttccttttgccacatagtagcactcttttaccccccattcacgcctcatgtttatgtgatcattttgtttagatcaacattcagtgtttgcattattctgactacgtaaatgaaattcagctgagccaaataatatacttttacttttccctgtatgcagggaaatgcaggtaattaatagaaattggggttgggcgtggcggctcacacctataatcctagcacttgagaggctgacagggcagaatcgcttgagcccaggagttcaagaccagcctgggccacaaagtgagacccccgtttttattttaaaagtttttttaaaaaagaaattgtaggtatcctcttgaggttgtggtctaaaggtgaataattccttgataagttctaagctgtcctagttccttggttagttgcaagagatgagacttgagtagagcttagagaacctctgtctgggccatgctggatgactgagttatacatctcctgtctttcctacccctttctctctccacacctcttttttaccctcagcggatagcaggctccaagctctctcccaggctccagtattttggtcagtcactgagtgggggccaggacctcacaatggatggactggtagacctgactgtaggagcccaggggcacgtgctgctgctcaggtgagaatgccttttggagtcaaccggacattctcccttgaaggaatgtttcctgtttgaaggtccctgatggttttctggtgtccctttaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggtgaggcttggtggatgagtctcaagaggttaaacgaccgaggacatgaatgggtgctgcaatccactctgcccagccttctggctgtcctgaactgagttctcacaggctctgacaaccttctccaagccttacctgagtgagcaggctattgtcctgctgggtagggaagtccagtggacctccctaaagaggtgagcatgtggcacttccttactcactcagttctccagagaactgaaggccccatgcctgtgaacaaactatgtttttgttttttaataaacggagagaaaacctatttggggagattgaattgatgaagctaaacagagatttacaaagcactcacatacgcattttatcaccagtgacttcttcccttgttcctattctcaaagagtagaactgtgtttggggtgggagaatagtaatgacaatactaagaataactgtctctagtagtgacagcactaggaataactgtctctagtaatgacagtactagaaagaattgtaccctctttaaaagtaaaattattagctaggcatgatggcatgttcttgtagtctcagctacttgagaggctgaggtgggaggggaggatcacttgagcccaggaggttgaggccagcctgggcaacatagcaagacccatccctaaaaaatgattacctttctaggaacagttttcctgtgctgaggagatagcattccagatatgagagcagccagcatggctagaaattaagagcaaaatgttagagagtagggaattgaagaagaggtacccttaaacctacatagaagtccccctctactctttggctgactcttaagacacgaatgcctaggtcagtactccaagacacccagtagaaaacagcaactgaaaagccaaagagctgatcagagaattcagcagctcctcagtgctggggagacagagatttgagaggccttggtaaataccttggtctttccattgagacaactgactagcaaccaagagaaacaatatacaatagaaatagacccacaggtgattcagaaattagagtgattggataggaatttttaaaaggtaactataattaatatcttcaagaaaaaagggaaaggatgagaacttcagcaaaaacctggaattcataaaatagagtcaaatggaaactctagaaccaaaaatcgcactgactgaaatgaagaattcagtaaatagatttatagcagattagaagcagaacagagaattagtgaacaagaagacagtcatttgaaagtatctggataaatatgcgataaaaagaaagaaaaatacagaaaaacaccataagagatgtgtgggatatggtgaaagatctaacaaacatgtaattggaattacagaaagtggtggtgggggaggagagagagagagagagaaagaaaataggaaagatggaataggaaagacagaataggaaagatggaataggatggaataggaaagatgcagtagttaaagaatttccccaaactggccagtcacggtggctcacgcctgtaatcccagcactttgggaggccgaggcaggtggatcacctgaggtcaggagtttgagaccagcctggccaacatggtgaaaccccatctctactaaaaatacaaaattagcaggtgtggtggtatgcgtctgtaatcccagctactcaggaggctgaagcaggagaattgaacctgggaggcggatgttgcagtgagctgagatcgccccattgcactccagtctgggtgacaagagcgaaactccatttcaaaaaaaaaaaaaaaaattccccaaactgatgaaagacatcaagattctttacaaaatcaaagcaggataaatatgaaggacattatatcattgtacgttataatcaaactgctgaagaccaaagacaaagagaaaaaaatttaaagtagtcagaaaaatacaataaattttttagtgagtgacagaatagctaccatttattgagcacttattgtataaaagacactgtgctaaatacttgataagcactatttcatttcctttttaccattgggagggtatcattattatcctcactttaaaaataaagaatggaggccaggcgcagtggctcatgcctttaatcctagcgctttgggaggctgaggcaggtggattactttgagaccagcctggctaacatggtgaaaccccatctctactaaaaatacaaaaattagcacggcgtggtggcatgtgcctataatcccagctacttgggaggctgaggcaggagaaacgcttgaacctgggaggcagaggttgcagtgagctgagatggcaccactgcactccagcctgggcaagagagtgagattctgtctcaaaaaagaaaataaaaaataaaaagaaaggaaggaaggaagaagggaaggaaggaaaggaaggaaagtaggaaaggaaggaaaggaagaaaaggaaggaaggaagaagggaaggaaggaaaggaaggaaagtaggaaaggaaggaaaggaagaaaaggaaggaaggaaaggaaaggaaaaaaggaaggaaggaaggaaagggaggaagagagcgaggaaagaaagaaagaaagaaaaaggaaggaaggaaggaaagaagactcagagaagtcagataacataccccaagtcacacagctgagaagcagaggagctgggccttgaactcccatctgccgggttccgaggctcaggcccctcactgctgtgccaccctgtcccttcaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccggtgagcaggctagtggccagacccctgggtcttccaagcatggagtgggcttggggagctgaggagggcagatccccaaatcccggctatctcttagaattgcatcgaggacccagtgagccccattgtgctgcgcctgaacttctctctggtgggaacgccattgtctgctttcgggaacctccggccagtgctggcggaggatgctcagagactcttcacagccttggtgagtccagagttggggtcctgcaggggtgtggaagagaccagagaccaaggtggttgaaactcattttatttgattgcatctaattttacttcaacatttgattttattgtttaatttcacaatacttggttattttctttcctttcatttgatcatatttattttttaaaagtttccctttgagaagaattgtggcaatgacaacatctgccaggatgacctcagcatcaccttcagtttcatgaggtgagtttcctttcctcctcacctcctccagagaaggacccgtaccatgacccgctcttttctcctcctggcccccaagggagccgggtgttcctgggctataaggtccggtgtggctgcccctccactgttgtctcttcatcaagtgtctgcgtctctgttctgctggagcaggcttgccacagggaagcccagcgccccatcccccggcctgtcttcttcttcccacagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccaggtagccacatccttctcaggctctatctgacctttgcttccccatcctcacggccggaggtggatatcaccgcctttgcctcccctgccttccagaaccagcgctcacagcgatcctggcgcctggcctgtgagtctgcctcctccaccgaagtgtctggggccttgaagagcaccagctgcagcataaaccaccccatcttcccggaaaactcagaggtcagaactcctggctcctcccctccttttctctttgatttctttggggattcttttcttcttcttctcttctttagtagtggttcctttttgtacaaaacagctttattgagatataattcatataccatccaattcacctatttaaagcatacatttcaagcccggcacagtggctcatgcttgtaatcatagcactttaggaggtcgaggcaggaggatcgcttgagcccgagagtttgaaaccagcctgggtgacacggcgagaccctgtctctacaaaaaatgtaaaaattagctgggcgtggtggtgcacacctgtagtcccagctactcgggaggctagggtgggaggatcgtctgggcctgggaggttgaggctgcagtgagctatgatcacaccactgcactctagcctaggcgacagagtgagaccctgtcttgaaaataaataaaatgaaataaaataaaataaagtatacagttcagtggctttgagtgaattcatagggtcttgcatccgtcatcatgatccattttggaacatcttcattacctcacaaagagcttctgttcccgttggccctcagccccagtcctcccatatcccccagccctatgcaaccactaatctactttgtctatagatttgcctattctggacatttcatataaatgaaataatcccgtatgtgatcctttccctagcataatattaagcaaggacttagcaaggatcattcatgtcgtagtatatgtcagtacctcattgctttaaaaaaattgtttttaaattttttatatatatttttgagatggagtttcacttcgttgcccaggctggagtgcagtggtgcaatcttggctcactgcaacctctgcctcccaggtttaagcaattcttgtgcctcactctcccaagtagctggggttacatgcgcccgccaccacacccagctaatttttgtatttttagtagatacagggttttgccatgttggccaggctggtctcgaactcctgacctcaggtgatccacctgcctcagcctcccaaagtgctgggattacaggtgtgagccaccgcacctggccttcattgctttttatttggtgaacaatatcctgttgcatggatgggccatatttcatgtctccattaatcagatgacgggcatttgggttattttttctctcatatttctgtcattgtctctcctttctctcactccaggtcacctttaatatcacgtttgatgtagactctaaggcttcccttggaaacaaactgctcctcaaggccaatgtgaccaggtgctctctgctaccaggcttctgcaggcagttgcccgtctgacgccccagcccctggcccatggtgggcctttgccctttgcccactggttctcccttcaactcatttgttcactcagcaaacactcactgaccacccaccacgtgctgggccttgtgctgagtgctggtgggatggtggtggatcagacgatagtggttcctgccctctcggagatgataatttagtggcaaagacagacaagaaatctagccattaatcttgcatccatctcaaatccagtatgagatgcaagattagatgggggacggccagtgttcttgggagtttggtgttcagagaagattcctaaagaaaatatatttaggagctgggcgtgctggctcaagcctgtaatcccagcactttgggaggctgaggcaaaacaattgctcgaacccaggagttcaaaatcagcctggacaacatatcaataccctgtttctacaaaaaaaaaaaaatacaaaaattagccaggcatggtggtgcatgcctgtaatcccagctactcaggaggctgaggcacaagaattgcttgagcctggaagattgaggctgcagtgagctgagatggtgccactgcactccagcctgggcaatagagtgagacccagtgtcaaaataataataataataataataataaaaaataaaagggaaaaaaagaaaatatatttagacaaagcaaaggcatgaactgagggcgggcatgaagacagaaggcaggaagcagataccagggacgggaagatcagggtgtgtttaagagtggcctcagcatgaaatgcagggctgaaggagttggtggtggttagatacaggccatgtcccaaaatgactgacgggtgttgtttgggatttgcagtttcgcctctgggagtgacataatcatatttgcatgttagaacgatcactcttcaggagggctggcgattggggtgggagcaggtgtgaattcaggggaccagttagaagaaggtggttgcagacatccagctggagagggatgggcctgggctaggcgggggcaggggttggagaacagtggggtttcagatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcatgagtctgtgcatgtgtgtgtgtgtgagagtctgaggatctctgtgcatgtatgtgtgcatgggtgtgtatttgggcatgggtgtgtgagtgtgatgatctatgtgcatgtttgtgtgcatggacgtgtatttgtgcatgtgtgtgtctgaggatgtatctgcatgtgtgtatgtgtgcatgggcgtgtatttgtggatgtgagtgtgatctatgtgtgtgtgcgtgcatgggtgtgtatttgtgcgtgtgtgtgaggatccttgtgcatgggtgtgtatttgtgcatgtgtgtgtgaggatctatgtgcatgtgtgtctgggcatgggtgtgtgtgcatatgtgtgtgtctgaggatatatgtgcattgtgtgcatgggtgtgtatttgtgcatgtgtgtgtatgaggatctgtgtgcctgggtgtgtatttgtgcgtatgtctgaaggtctatgtgcatgcgtgtgcgcatgggtgtgtatttgtgcatgtgtgtgtgtgaaggtctatgtgcatgtgtgtgcgcatgggtgtgtatttgtgcatgtgtgtgagggtctatgtgcatgtatgtgtgcatgagtgtgtattcgtgcatgtgtgtgtgtctgaggatctatgtgcatgtatgtgtgcatgggtgtgtatttgtgcgtgtgtgtgtctgagggtctgtgtgcatgtgtgtatgtgctcatgggtgtgcatttgtgcacgtgtgtgtgagtggcccaaatgggcacgcactgtgtgtccagcacacattggttcccccatccccctgcaccccaccccatctccaccccccaggacttcatacccattacccatgtgcctgttcgctccttacacacttagcctgagacaccctcccagggcacccctcatgttttgtcacctcctgtcccttttttctcccttcagccatggggtctccactaaatatctcaacttcacggcctcagagaataccagtcgggtcatgcagcatcaatatcaggtgggcagctgggacgtctgggtcctgagaaggaggctggggaggaaaatcgatggtagaaaatgcagaaacagggatgggaaatgtgcgcaaggcacctgtggtgtgccaggcttggttccacgctgctatcactcagtatgcacacatacacgcacgtatgtatgtgacatgcacgcacgtagttatcttgtattaccttcgtagcgactctgtggggcactgtcatgatccccagtttacagatgaagaaactgaggctcagagaggtttacagaacaagctcgaggtctcccaccgagtaagtgggagagctaggactggagaccaggccgtgtggcactggaatgcgtattacatgtacactctactctctcaaacaggaaggggcaggacgcccgggcctatggcctgccccgtggggaggggaggctgattctccaggctggtgggggaggaaggccagagccctgaccccgccctccccggtgcaggtcagcaacctggggcagaggagcctccccatcagcctggtgttcttggtgcccgtccggctgaaccagactgtcatatgggaccgcccccaggtcaccttctccgaggtgagcggagctcggcctgactcctgcacggccctgcgcgttcctctcacctctgttaatgctattgggttttagagccgctccgcccctctcctggacccaggccatctcacctcccgagatgaggccctggcgccttcatctctgccccttctcagtgcgtctctttcctcagaacctctcgagtacgtgccacaccaaggagcgcttgccctctcactccgactttctggctgagcttcggaaggcccccgtggtggtgagaagctaagtcagccccagggccacacagagacccagagcgcttccctgctggaacctgtatggtctctgagcaaacggggaggggtgttctctgccttcggcttccttacccgtcccctcccctcctgcgttccccagaactgctccatcgctgtctgccagagaatccagtgtgacatcccgttctttggcatccaggaagaattcaatgctaccctcaaaggcaacctctcgtttgactggtacatcaaggtgtgtggggtcctgaggcttcgccgggcacaggcgtggtgctcagggcccaggtgcagtgcccacccgctctcttccacagacctcgcataaccacctcctgatcgtgagcacagctgagatcttgtttaacgattccgtgttcaccctgctgccgggacagggggcgtttgtgaggtcccaggtacctgtcttgggcgctgaggaactattggagggagaggggctgcgcttgtggagatttctgggggaggagagagagacacaaagagagagggagagagagagacagagcgacagagagacagagagatacagagacgtaaggagagagacagacagagacagagagatagaggcagagggagaaacagacacagagacagacaaaggagagagagatagagagtcagagagatagagatagagacagagacagtgagagatggagatagacagagagatagagataaagagagagatacagagcgcgacagagacagagacagtgagccatggagatagagagacagagagaggcagaaagcgatagagagagatagaggacagagaaacggaggagggagaggagggagaagaggtgggggaggaggactgagggctggggttctgggggacatgaggaggggttccccacttgattcaggggtgcacacggtgtgaatggggaacccccagaaatccagagtcgtctcccctgacgcccctccttcctcccccagacggagaccaaagtggagccgttcgaggtccccaaccccctgccgctcatcgtgggcagctctgtcgggggactgctgctcctggccctcatcaccgccgcgctgtacaaggtgctccccgctgctcccccaccccctcccttcatcctctcgggcctcgcgctgcagctccgtgcctcggtttccccggcggggctgccagctgtgtgactggggcgagtctgggagcctctctgcgcctcagtctcttagggagggtggccgggttcatgcgcggggcgcgctgagaacgagtcgccctccttgtagtttctgtttttctccaggccccgacgcggatgtcactcccctcccgccccgccctcctgggtcccttctgtctctgccggccctcccgccccctccccctggtctgcggagccgcacgctccctggctgctgtcgctctcactgccctcctctgccccgcagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcaagtgtctgtgtgcaagtgtgtgcacatgtgtgcgtgtgcgtgcatgtgcacttgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggaacctcctccacaccagcgctgatgcccaataaagatgcccactgaggaatgatgaagcttcctttctggattcatttattatttcaatgtgactttaattttttggatggataagcttgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcatatatgtaaggataa

SEQ ID NO: 899 - DNA, 72927 bp, Homo sapiens; identical to SEQ ID NO: 898

SEQ ID NO: 900 - DNA, 162398 bp, Homo sapiens
tttggttttagtcagttctcttcttgtttttatttaatgccataatattatattagcatatgccgtaacatttaaaaatgcccattctctccagcttcagttcaagcaggagtggggaaggccatagactaagcccaccttcaaggtcacacttccatattttgcacagagaagaaaatgcagtctcccatccagatcctcagacccacacaccagcccaccactctcattccagatgccctaagcctgggtctggacacatgtggtcaatacacatcctggatcttacaaatccaatggtggccagcagtagaactgaagcctgtaagttttcattcactcctaaagtgtgctgagaaatcctagcctgttttttccatttaattcctgtagatgagtcatttgctcctcagttttctatggcccaattttcccattggaataatgggaataatatgtcatccaccttacagggtgatgactaatatattggcatttgagatccttagatgaaaggtattactgtgtataagtataaagtactattatttagtaatcactgagttggtaaatgtattcattcatatggagtttttggaggaagagctttaaggaatgacagcagtagaaatgcagctagatatatttttgaaaacattttttaggtctaccaacttagaaaaagtcccagatattacatactccttctaaagcacctaatttgcatttttattattattattatttacctagaactacagaaaaatttatgggaaggaaagtaagggtacagggttttcaacttggggaaattcatttcccatcccctggctgccaagccttcctactcacaattccacaaatgtgcctgcagctgtgaggacagctggagagatctgttgtctttctggtcacctctgacattttgcagtgtctcttctgattgacactgtatacagggcatgacctctctgacttggccctgcctattatgaaagtgtcaccatgggggcagggagctagagagatttagttggtttaaagaagtataatgtgtccttgagctttgagcacagcaatggaaacctggcgactcttcctggagctctagggacttctaaccagagcaagttggttcattacaagctgtcacaccacagaaagagaagacctttggctaaggtagagaaaggctgactcatacaggcagttgtataactgtagacaggcagggcccatggagctgtggagagttcactgggactcctctgccttctaagacacaggttcccacctgcttcagggagagagacttcccactagtccaccttctgtgtgtgttaccaaaaggaagccatatttggagctggtctaagctccagcccctgcaatttcatttgcctttccttagtaaggaacacagtaacaacgcgaacaaaaccacacagagcatgtgaagaccgggcccttctgatgctgatgtgtggagaaaactgggcactagactgaacaaatttttagctattgccttatgggaaccacagaaatggattgaaataaaacttacaaaatcactttaaccactcttatttatgcattaccaccaagggaaaacaaagtcactgaaacagaaaaatgttttccaaaggaaaaatgtttcctctttggtgacctgagaaagtttaccgtaactccattcaaaaccttcaggcacttgacttttttttttttttttaatatcctttacctttttaataaaaagtaaaaaacaaacaaaaaatacatcaatgttccgaatagaacctctctatgtaaaggtctcactaaacaaataaacataggaccagacaaaagaaatggagctgtgaatagcaatatgatatattatgaagcatttatatatgtatgtatatattatatatgaatgtgcgggtatatgtgtgtgcacctatgtatgtataaatctgtaaatatttgcctacatacacgtcacacacacacatacatatttatactgacctctttagattgaagtccaaggcactttttacaatgaacaggttaaagccattaatttagaacataactgtttctgggtacatatcgagttatggcgccaatatcagaattcacgtctttccttgcccaccttggagtgtttcttgttggtgcaatgagtaagagaattggctttcaaggagattagcaatgtttctagatggttaaactaacttctcttgctattttcctctaggggaggggagttcttactggtgagatgctgagttcctcaagggaagaacacaaggatcgagaaacacaacaatttctgtactatgctaagcagagactcctgtagccttccagaggacctgccctgaggttccacctgatattctgatggctttgctagtctggtctaaaaaaaaaaagactaaaacttaaaaatgggggctttgaggtggctcaaggatatggagtgctatttaggtaagaccggaaaaagactatctcttattgactttattatgtttgatgtagaccatccaagttatataacctcaagtggaatttaaagatgcatttttttaatccttatgatcattcaggaccttcacatcttcaaataattctgtaaatgagactcaaggaagagatagcttcattctctaattattaacgaggttagttatcactacggtgaggtgaggccagtgcttatcaatatttctggtgcatacaggtcacctggggatttgttaaaaggccaattctgatgaagaaggtttgatgtggggcctgagattctgcatttctaacaagcttacagatgatgctaacgctgctggtctgtggaccacactttgagtagcaagggttagcatatagccatggacttgaattactgtcaagaggtctgctttccccaaatgatgaatttgcatttgtttccttgattctagatggaatacaactttgaggggaaaggtcagaatatatttgctctttataaatgtaagtcttggtctgagcagtgttagaaggaaaaaccaaaagaaaaaagcacttactgggccaggcacagtggctcactttgggaggcccaggcaggtggatcacgaggtcaggagatcgagaccatcctggttaacatgatgaaaccctgtctctactaaaaatacaaaaaaattagctggtcgtggtggcacgcacctgtaatcccagctactcgggaggctgaggcaggagaattgcatgaacccaggaggcagagcttgcagtgagctgagatggcgccactgcactccagcctgggcgacagagtgagactccatctcaaaataataataataataattttaaaaaagaaaaaatcatttagtagcaaaaaaaagtgaagaaataaatcaattaccaccaatacattcatcagtcaattgtaaaattgaaaataagccaatttccattatccggtgagtaagtaacctgataaaaacaagtgccctggagttcagatggctttagtggagctcggcctaacatataactgaggagtaatacaggcactgagagaatttagctccataacaagaaaacttgtgtacaagttagggctcagctacacaaacagactgaaaacgggcatttagacatttctctttcaaacagcatgaatacctaatgtcagtgagccccatgacttatatacctttaagctcatataaattgaaatttgaaggattccagccttttcccaggagaaaacttgttgttttgcactatctgtaaatctatgtgaattttcagggcttgggaagggaagagacacataggctcagttaatctgccccgatgcaacctggtttgcacctgtacaatattgcaccaaagcaacaacagcaagtgagggtcccaggtgagaagaggctcactgattctagaaaatctttattctgtaaccgaacacatcctgttttcatctagaagtagtgccttagccatatgaaggagggaactgagaacttctacatgtatgtctcagctgctctgtagagaaagaggggtgtagattccatgagttgcttaattttgctataaaggacaatatctcaacgggaaccctttatttcctcccagctagaggaagctagcagaaaaggcagcccggctctttgctggctctggctgttcatgtcctgccggctcctcccatcactcccttaggagctgggctccatgtccttgataaacatgtgggaaccttgctccctcaagggtattgccaatttagaaaagcacatctgcacactggactcttgttgggccttgtgtagtttggaaagccgaccccggtttcacgtacatggagaaactcagaatgcctaggattttgagtattttaagttacaggaaaacaggactctttcttatgtccaattctgacattgtcaaaggaaaactggttggctaggtttgagacttatataatttatgtaatgaggcctttgaatttatatagaaagagcctgaacttttattaaactggctttgcagagctactaaaggagtgatggcttttaaaatctcttctgaaatggcttgatagaatttagggtagaattattcctctactcttggaataatgttcttttgtctctaatacccaggccttggagaattagaatatggcagttcagtaggctgtggtaggaggaccctttttctgggtgcccggcaatcactaacagtgatgtgtactcagaaacagtcattgggagagcaggctgacagtggacctgctaaacactagtttgatacaaaatgttaattgaaagttacaatatattttataatatatcaatatatttcatatttaaaataaactgttatgctttctcctatcattaaaaaatagcaagcagtacagaggcaagatgcaaattcatattaaagctcatctgattctgaatataaacacttcagtttctgagcttgccatgaaaatgtttcctccattaacatcctgtcattctcttgttgttctcgtggccagtgcagaatggagagtctgggaccaaaattgagttgttgcgccattaaaaaacgtatctgatgaaggtggatcagtcctggttgagattcaaaaactgagacaacatgacacagctagagaatgttgtttattccttgtccttcttgagtgaagctggacgttggctgcttcgatctgattcagatatatatatatatatatatatatatatatatatatatatatatatatgtactttttctttttggctataaatgtcaacatctctttgggatcctaactgcaggttggagttgaattttgtgcttttcctccaccagcttggttggtcacgatgtgtctcttttgcttgtttcaacacatagcccaggcccaagattacagcttccaggatacatttttcaggtgtgtaaacaactgtcacagggcacttggcacctagatttggaggtcatatgttgaagatttgacaatggttttgttcagagggaactccagttcacgtttgggtgtttccagtaatggcgtaagacaaaaagatcacagttatatttttttctatctgtatatatgtatataccattgcactgagtactttttaataagctgtggtctgtttcaataaaaatctacatattactcgtctaacaggagtttaacattaatttctattcatgcagcctggcacaagctttctactaccacaagcagacagttactattgcgatccctgtaaactcctttctcagtggtgttaatgatcccatttccctaatgtttattttggcggcagtagagaaggaaaggatactgtctggggcgtcatcaagcccaccgactgcaaggggagagaaggggttgttcgtgcctactgggaagtcaccagatagctgtctaaggtactgaaatcaaaccctgcagagtcaatagggatccttcatctgcttctagcaactcttaggggaagaagaatgaatgtagaaaactggggacatattttaggatttaaaaacagtaacttcaaaagagtagtaacctactggtagtgcaatgacttcacagtatctcagttgtggtactgtgatgggagcaacaccgtttgtcctgggatgaaacattgattcttaatttggagtgtactgtttgttgagttgcactctggaggaggaggaaggttctggaactacgtgctaatcccatatttctccctgctgattttaccactatttaatgtgcactaattactttttggtaactactgactgcattcaaacgtaacatcaaggtgtgatctagatacagtcagtctgggctgctgttgatgacaaaggtgatttcatttgttctctattgaaaacattgtacttaagaatattaattattctcttcattttaagtacagagaaattgatgtattaggtgcttatatgaattggccaaagatgtggatccagtcttaagatttttatttattctgattttgtatgactaggtttcttcttttccatgattgtttattcacaaggaaattataaaaatttaagggggaaatcccccactatattaaaatcattacttcttcaatgctcttccttcttggcttttaataataaaaatagcttgtacatgctcagcgcttggaatttacttttgcgtacattttctatgtctcctaattcacaagattgttgttctaccactggcccctgctgaggtcggtcagtggtgacttggggccttccccccttgttcttttggattgtattaagcacttctagagacatgatgtcatgaagttacgtattaggaagatggcaagagcagttcatagacactttatgacaatttattgatgatgatcatatatatgtggcctttgatccaaaggtgaagacttttatttggacttcaatctaaggaggagtgagcccctagtctggtgtaatttaccaactaatgctatgtcctgaaattccactgagattagtggtcttaaagtatcacagtacatccctgactttacagtacatgaagctttaatatggcttaagcaatggcaggggtgggggtggttctgtatttctaattcaagtgtctagatattttaggaatattagagtgattttacctgtcactgagttgtcagaaagattatagtaggggatctgccattgggtcagtcctctaggagtgggcagatcttgatcagtacagtattggagtgaggttacataattaatagtttttacatatagccgattttttttttttttttgagacggagtcttgctcggtcacccaagctggagtgcaatggcacgatcttggctcactgcaacctccacttccggggttcaagtgattctcctgccgcagcctcccaagtagctgggactacaggtgtccaccaccaaacccagctaatttttgtatttttagtagagatggggttttgccatgttggccaggctggtcttgaactcctgacctcaggtgatcctctcgccttgcccaaagtcctgggattacaggcatgagccaccgcacctggctatatataccagattcttgagcagataattaaacctcctccaccacaaaacttgaaaataaggtacaagaaggcatgacatgagaatccacctgccccttttcccatctgactgtgatgctgaggtgtggtggaattagccaaaagatgtaggaagaaaacttgggtgagctacacccagaataattaatacttaagtcatcaagggttgattgtacttgcaggagaacgggtaactttcccacataaagctgaaatgctagtacagagaaatagccttccatttgctattacaggatcaatgtgcaggtttgatcactttttttttgaagcattttcttttgccaagaataaaaatcatgtatagctattgcactaccaataggtcaattcatgctacaaatgtccatgtgtttctaggatgccagtggctactgctaccagaaataactccagtcactcccttgactagtgttgctagtttggtctttagggtttacctaagtgagagcatcaatgatgggttaaagtcacagaccacaatgaataaatcacagtctgtgcacacttttggccaggaagagtggcagtggaatcttgcatgtcatttggttgaaattaagactaaatctctatatgtgcacacacccacactcacacccacacgcacacatatcacagggttatagcagaatgaaaacggtgggtaggaatcaccagttgaaggctgtaggtttaaatgatcaggattggcacactcagatcagcccaccagtggtcttcactttgtgaaatggaactaatgccacaaggaaactgcatggttacttcatctgtttacacatctgcttatatgttcagctgaactgtcactgaaaacaggagcaccattcttgggacatgaaacaaggaggaggggaaacattcagataatcaacagttaatagaacaagtaaaaaaataagccaacagcaggtgcggcatctctggtatgcaaaacaactaatgaaagtgttcaaaggaattatcaaggcaggccattaagactataaaccatcaaaagagcagcagcaatagcaagagagaaagaagagggttagcaagagactagatcttcctgaaaaagtggccttggctctacaattgtctaccttgtgctgtccttagaagaacaggcccagtgctacagaataaaaatctccatgccaagccactgccttcagaatggtgatgatgtcttcttacaaaggtaaacccaagatgacaaccacaagcaaaaaaatcacccttttgttttaccatcaacagatgaaatagtccatacagtgccattcaatttcccacaggcagaaaccaaagacctcagaatgagaaagtcatggttttcacgtcacaaatgttacgtgtggtcagattatggagcaatgaaaacatttttctgcgccgctcattacactaaatcttgatgtttctgaagtctcttggagtttgagatgtattggaatagtttttcgcaccaagattaacatggcacagtaggaacaggctactgacaaatccatgtccacttaccttacccacaaggttccctaagggttcccttcattctcacaatatttcattttgagatgacttaaggtcaggtagaagggaccacataggccactcttcatcacttctcctcctagctcagaggctcacaattgaggcacttggcccttttgcactactaacatctggggctggaaacctgttgctggataaatacagctcagcaaatccccaaccatatttctattcactaaggtgttattggattgctcctgtttgtgcatgtctgcacacacatgcacaatttcttgtcctctccctccacacttacagacatacacctggtcatgtggaccatcgaaacacaacttgtttggatggaagaagaaaactctgcagatgctgttatttttagaagcctgcttatccctcctgaatgccaacaattttggcttggcatccatttcaaatcaagcaaggtgcatatccaggacaaagcaatgtgcattatgtctgaagggatccacatcttcagtgaaactcagaatgtggccagaactagctaactacctgaactgaaagcaccccatgttcagattcagaccaactcaaaacacatgtaaggggtgcctattgtatgcagggtaaggtgtcaagtccctttttatttggattaagctcaaataagaaaggacctgaagcgaacgtgggatgtgtatgtgtgtacatgtacacgtttgcaaacacacaggtttatgtgggtattaatatcgagtggaaaatctggctttttatttgtctgtgtctttttttttttttttcagtctgattcgagtatatctgttttggcaagttgtgggcagctctcttttacttttgtcacccagaggcttccgtagacaaaaggaaaggagagaggtgtgttcaaagacccccatggcgaagagcccatcccccaagcctgacacaaccctccctcccagcggacccctcttctggactggcttcgctgttggctacttcagtgcatctgacccccaccccccgcgtgaagacctgagattgagcgtggatttctgttctccaccaactctgcagcaagggccctgccagaggcgtcgcttcctgtcatctcctcttcccgctcccaagtagaggcacctaaacagagattagatttctggtttcaaggcatgtcggaccaagcacgctgaatgaacatgagttagttaattagctcggtctctcttctttccgttccctggtctgaatgtttcttgatggcaaagcgaccaggagagagttgatttgcatcttaagacctatgggtaatgcttctggagtggggagatttatttagcaactgcttgaacttgtgtacggggtcgggaaggaggtggagctgaccccaatggggctatcggagattggggtgtgggtggtgcccactgccacgctgacaccccgggcctcgatgatggcagacaggagctgctgctgctgctggcgcagggtgtcggcgatgagcagcggcagggagttgaagctggcggtgagatgctccagcttcgactccaggctgccaatctgcttctccaggtcttcgctccggtcattgagttctgtgattaagtcatacatgacattctgcatctgtgtggagagagagaggcgagagacagggagatgacaggtcatcacagaggaatctgcaatgggagaaatgaaacgccctccacagtatgacaggagccacttccacaccagctgatctggtcaaggaaggatacaggcttctttcctggggatggggatgctgaagtgtgcacatttttgttttcttattacaaaagtaatgagtattaatgacagcattttattagaaaatatgcaccaaggggaaaaaaatggcccttttttttttcttaaataaagtgagtctctaaactgtctcatgttctcacagggccacaacctctcagctcacatggctgctggcatctaatgattccagagaagacgctggtggggaatggacagtgcagtgggtgtataattagtaggccagggctcaagtacacatctgcagctcactaacagtgtgccctctgccaggcgcctggcctctctcaatctcggttgccttataaaattggagttaataataactgtacacagttaggagttattgcacatctcccaacctctattttaacccagcagacaggatgtaaagtgaattaactctcaggcacagtgcttagccaaaggaggctgccttgctgaggtgtggcccttcgcctgcctgatccacaatgcctcagggtgggacatccctgaagggccactctgaagggctgaggtctttgttgactgtatcacagttcaaaccctcccactgaccaatcctgcttccctcactccttggcaggggtcctgagggtgctcccctgagagctccccagtacccctcctgcactcagcactgactccccgtgttccaggggtgccggccgattaccagtgctccttccccaacatcctgtggcccccttgttggtctgcagagtcccagtctatgcaacagatatttttctcccagcaaattagcaaatgccatcttggctgtgtacatcagacttgggaacaagattcacaagcatcttcagcctcccacgtgtcagggagtgaggctcctggggcggcaatgcagagggccaggccggtggttgcttggtcatccctgaggtactgtggctctttgggtttctgatgatctgccagtgacaccccgatcctatttcacgtgaaatttcaggttactctaggaagatatggacatgatttatgccccagggaccaaagcagcagcaagtaaggtgagaggaaaaaagaagagtaaaagaagatgtgagaagccagagaagaatgaaggggagcaggggcacaaaatgcagtgaggcctccccagcagactacaggccccatgaggaaattcactggggcagcataaggaaaggtcacaaggtggcatggagatggccccgctcccatgagctctgctgttgccagagcaggacaccgtgtcgtggatgcccttggaggacagggtgactttagaagtgaaagtactccctttattaatcaacatgacagaacctcctcgaggcaaacattcttcccggaatgtgcaaaatcacccatttcatttgaccgcaggggcaccctgatgagctctggactcagagtccaggcccctgggttgtggcccccacgctggtgctcaccaactgcctgaccgtgggatggtcactttgttcccttggatcttggtttcctcatctatattgataatcagaactaccaattgcaaaacctttatagtttacaaagcattttcacagatatcatcttattcgatcacctgagcctccgatggtaggaattatttttatatttcaattgaagtaattgaagcaatcggggaaagactccaagccctcccagctctgccagcctataggacagcaattcaatacagacgtaatatgtggaggccacatgccatattcttaatttagagaggaccaaagggcaggagtgggaaggcgctgacttgggaggctacagcacaaagacagaaaagagagagaacacagcgttattgtctccccctgttccgttgcttggtgacaggatgccagggggaatatggaccagtgtgaagtgtgctaagctgctgccaggaccttgggtgagtctcctgggaggaaaagataaagactgggcgaatgtcagagttcatctcctccccagatctccccacgggggttctgcagatttttcccttaaccctttcctgcacactctttctttccaggtaacttgctcctgggttatttacggcttagttcccccacccaattcacaggagtgtctttccagttcactgaggggttcgcttcacccggtctgctccgtgggccccatctctccaagaggccgtgggtggcactgcagaaatgcaggcttgaaagtttggtttgcccaaaagtgggcgaaggatatgaacagacacttctcaaaagaagacatttatgcagccaaaaaacacatgaaaaaatgctcatgatcactggccatcagagaaatgcaaatcaaaaccacaatgagataccatctcataccagttagaatggcaatcattaaaaagtcaggaaacaacaggtgctggagaggatgtggagaaataggaacacttttacactgttggtgggactgtaaactagttcaaccattgtggaagtcagtgtggagattcctcagggatctagaactagaaacaccatttgacccagccatcccattactgggtatatacccagaggattataaatcatgctgctgtaaagacacatgcacacgtatgtttattgtggcactattcacaatagcaaagacttggaaccaacccaaatgtctgacaatgatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacaccgcatgttctcactcataggtgggaattgaacaatgagaacacatggacacaggaaggggaacatcacactccagggactgttgtggggtggggggaggggggagggatagcattaggagatatacctaatgttaaatgacgagttaatgggtgcagcacaccaacatggcacatgtatacatatgtaacaaacctgcacattgtgcacatgtaccctaaaacttaaagtgtaataataataaaactaaaaaaaaaaaaaagaaagtttggtttgcctcatgtccccagggaacatcagtcacagcatgtcctgcaaggtgagaggagaaacaggaaatactgctactcatggaagaaacatcctggggcagtttgttgggctattcctgaagctcacaggtgggcccctagccctgtttgctccatatgaccctcttcctggccaatgctgattggtcccagggtggatacgtggcccaaattggccaatcatttcttctattctgagaatttagaattaagactagtagggggccaattagtctttacctgtggctaaaactattatatgtactctctgaattggagcctgttacagtctgtcgcggggacaggaggcagagagggagagaaagagaggaagagagagggagaggaagagagagacagggaaagggagaggaagagagagacagggaaagggagaggaagagagagacagggagacggagaggaagagagacagggagacggagaggaagagagagacagggaaagggagaggaagagagagacagggagagggagagagaactgaagcagtcacttaaacagaaggacagagaagaaatggtgagagacctcctggttgtgggggcttcccaggtctagttcgagtcagttccttcctgcagtctggccacatgtctcctttgaggttttgcctggaatgagactcccttatatccttagaatagatttctccatttttaaacctagtcccagcgggtttctgatattaaaaccaacacacccaaaaacctgagggagttctctcctgcatgcccacgttccactcccaccccaggctcctaggaaccaccctgcactccacgtgaacgccctcctccaaaggcacgcgggcctggaggcttctccccaaatgtgccaagccacttactccccgattgaagtcctcacaggtttagaaggccctttctttggttcaatccctttattaaacaaggcacctgcacgtggcccgacaactagtgatttctctgattgcactcttttcaaagggtgcttaatgtgcctgagggagtttctcttgcttacccagggaatgtgttccattatgataattgacatctgctggaatgttctgccagcctggccctgggctgtacacttaatatacaattcctatcaagaggcaatgaggagagggggctgaggagggggaggccctttcttcagtggcaccgactctcagctctgccagcagtgtggccttcggctccctcacctgggtgatttgcaagaggagtttccttacagtatttatggcagctcagggccagaaacagagtggcagagtgatggcgagccttacaccctagggctctcaaaagagggctctctttttgggtatcttcatgttccttgtaggctatctgcctcttgagaagtaaagaaatgcacccccccacacacaccactgccgccaatttgaggccagcaaaactagttggttaaggactggaggatgtacaaaaatgaacttccaagtattacagcaaaccggtgtgacctgggcagttaccatggccatcgttaccgtctggtccttgctagcatgcttcacagccgtgcaaactcaagcccaacctcaggagtccctcaatgtgcagctcataaaatgacacggaaaaggtttagtcagctcattaatttcacgcagagacacacctgagcgatttcacttaagaaacaaacaccaagtttcaaaagcccacaagacataccggtagattgcaaatgaaacaaacttgagcctaggtatttttgaaccaagcagaaatttttctttgcttgcctggtcccgcgctgtccagtgcgaacccagccaggactcacaggtgagcctgagaagactcagtgtctgcgtgttctaggggatgtctccagacactgccactcaccttggaaaggtccaccagagtgttggcttggtcactcagcttcctctgttccatcttgacgctcctcaacctgtggggaagaatggtaacaggcaagcccttcaagtccatgcaaaggtttagccccaccagcagatcctccagccctaccactgcctctgattttggaacccagcatggggaccgtgaacctggggaacaactgaggcttttactttccaggggcttgtcacatccccccagaaagcaaactcttgtctccacgcatgctcaccttcagtcactggtttcttgctattcccagatcatttccctgcctctatgcctgggctgcaccttccatgttgagtgccttattctcaacttttcagggattccccaaacctctccatcagaatgaatgttttcatcctttgcttttccactatacttttaaaaactcctccatcacagaaagcatcagccacggtttgttttgatttgagttgcaatgcatggtgtgtgtgatgtgtggtgtgtgcggggtgtgtgtgtgtgtggtgtttgtgtgtggtgtgtatggtgtgtgtgatgtgtggtgtgtgcggggtgtgtgtgtgtgtggtgtttgtgtgtggtgtttgtgtgtggtgtgtatggtgtgtgtgatgtggtgtgtgtgggttgtgtgtgtggtgtttgtgtgtggtatgtatggtgtgtgtgatgtgtggtgtgtggtgtgtgtgtggtgtgtgtgtcgtatgtggtgtgcatggtgtgtgtggggtgtgtgcggtgtgtatggtgtgtgtgatgtgtggtatgtggtgtgtgtggtgtgtggtgtgtatggtgtgtgtgtggtttgtgtgaggtgtgtgtgtgtggtgtttgtgtgtggtgtgtatggtgtgtgtatggtttgtgtgaggtgtgtgtggggtgtgtgtgtgtggtgtttgtgtgtggtgtgtgggatgtgtggtgtgtggggggtgtgtgtgtggtgtttgtgtgtggtgtgtatggtgtgtgtgtggtttgtgtgaggtgtgtgtggggtgtgtgtgtgtggtgtttgtgtgtggtgtgtgtggggtgtgtgtgtgtggtgtgtgtgtggtgtgtgtgtgtggtgtgtatggtgtgtgtgatgtgtggtgtgtggtgtgtgtgtgtgtgtgtgtgtgtgtgtgtgtgtgtagaatgtgaaagctcttagaggttcttactctagtttttaccttccatagcagcctgcccaattcctggcatgtggctggtgcagtcagtgagtgatcagacccagttcaccactccacttgttgagtggaacagaatggatttcttctgtgctactgacagagttgtaggagtcccgccactcccagtctggtcatctgatggctgaaccgctctggcatactcactggtggatagcttggaggaacttcctctggtgtttcctcactttggcatggtcaatcttctttagcagctttgtgtgtttatagattaaccatgtttcccgaaggacattggctgcagcattcttgatctaaggaagaataaataaagtaggctgctatcaggttcattttcttaggttcatttttgtggttgctactgtagtctacctcataaggaaacgattttgcaatgatctattttcttaaccaaaatcacggaactcctagaaaagatgattaaggccgggcacggtggctcccgcctgtaatctcagaactttgggaggccgaggcgggtggatcacctgaggtcaggagttcgagaccagcctggacaacatggtgaaacccgtctctacaaaaaatacaaacttagccaggtatggtggcacatgcctgtagtaccagctactttggagactgaggcaagagaatcgcttgaacctgggaggcagaggttgctgtgagctgagatcacgccatactccagccttggcaacaagagtgaaactccatctcaaaaaaaaaaaaaaaaaggaaaaaaaaaggtgattaaaattcatctgttcttaatcttgtgttggacactgcagaccagagcttgaagttggagggtctttctttctttctttctctttctttcttcctttctttctttctttttctttctttctctctttctttctccttccttccttccttctttctttcttccttcttgattatttcaatactatctcttgactgctgttgctgatgctatatttagacaggctgcatgagcgagaccttgagtcccggggtccccttggaaaatagctagcgatataccattgctgcccttacatgcagacttccgagctttgcctgagattgccacttcgtgtatacggtacattgcttgggttcagagagtaaacagatttcctatcagctggagattttaaaagacttctttgagaaaatgtctttcccactgattggaactataggtaccaacgagcccattgtctcctttcccaaatggccaaaaacatttgcactgcaattgtacatgtaaatgtaattggcacaaaaaagaaataatttcagagcaatgtctgaaaatcagtgaagatatttaggtgtgaaaccagagcttcctcttccccagggctggctccttcactgtgcactgcaatcacacgtttcaacatatgacgctgtcatccattgacatggaaaccactgatatcaccaggctcatgactgagctgagacatatcaatggcatccagatggcaggggacaaagttttaatccaaacacagacatcttcagcaattagtaacaagagcaacagaaaacattccttattaagcacatgctaagcagatttttgattaaccatccccatttctgtcagccatgcagactggcatgtgtccacaggcctggggcctggaaataagtaggccagcctaatagaaatcaggttactagccagaaaggattttaataaaattagagaatatagacctgcttcttcagactgacatcaacagatgggatgttgttaaaatactgagatgtgtgggaagcctaggaaacattgttttgcaggctgataacttttgtgtgtgtatgttttaaaaatttattactaaggctggattatatttttcattggcgctgaagtgatgtttttaaaagaacagctaagtcttctcagaaatgtctaagggacataaatattgctttttaaaaattcagtaaagatctgctgtgaaaatagttttaaatgacttaactgcccacctctagtactttcttgcctgaaaggaagcaggttgtggtggaaagttggaaacggtggatgtccaggagaggacactgtggtctctgggcttctgctcagggaactagagtgaacagcagcctcctggcaaaaaaggcggcacggaagggaagccttgctctctgcagagcacacatttaatactactgccctcctcttgcagggagaggaggcaattggatgtgtcatttcttcagtttccctacgcacttagcctcttaggaaagcctcaaggaaactggaaagtctgcaggtgaatccctgctctgtcaattattaagcagtttaggagcaaatgcttcattatctgtaagatgggaaaaataaagagggctgctatgaggcagtgatgatggtgctgggggcaacacttaacatctaccaggtgcagccacaggtctgagtacttcatatgtctaagctcctttaatcctcaccacaaccccatcagggaggtgctaacattatccacattttacagatgaagaaaccaagacacagaccaagactagacaattattaatggcaaactgagtcagtgtgggtgtgaatgctacataaaatgtaaagtaccatacagatattagttaatattatctagctcaaacccctcattgaacatacgaggaaaccacttcagagatgggatgtgagagccagaatcacacagctagctaatggcaaagtcaaaacaagagccacgtccaggaagagcagaaggttttcatgtggactgaaggaaagacaaacaaaatcatttcctgttttccaggatcaaggaactggaaagagcactggattttttttttttttaaatcatcatggccctcacttagcaatgtgacagaacacggagtccaggtcctgcacttaacgtcagcccaaatgtaagatactgaagtcacagcacggcccgggtagctgagagaggcagtcacatcatctttatgagtttggagggaggcctccgtgcattcgggaaagtgatgttaactgccagcccttgcactgactctgaaattaattaccagcaaacagcctggcacaaagctaagtagatcaatatctgcgagagaaaaagaaataggcttttaactgcactgtgctttcccaggtggacagtaaatgctattgtggccagggtctccctccagttcacctggctgattgatctaagcattgttggggtcgggagcacatgaggtcatgtgcccttcctcagatttgccgagcctccaaagggctccatgcacccttccttgagggaggcttgggtaccacctgacctctcctggtgggcagaggcaccagggccaaaagatgctctcagggtgcagcagtgcgagagggcagggcttaagatgaaagcagcaagccagaaagagtggctcaaggttggccacaatcggatgggtttggggatggttaggagaggaccctttgtgaatggaagtccagctgtcctgcctccaaaacccataaacaaattggctgattgttttctgcaagcccaaaaactctctaccaaaaaattgctttcactctgattggggccagacaatgggctctatgatctactttaggaaaggctctaagattaatgggcctgggcaagaaagtggtccaatgaagaccttgcaaattatggtgacagctaacatatactgagtgcttactacgtgccaggctttgtgctaagcacatatgtctgcactggttcattaaccctcagaaaaacttgataaatagacgtgatcatcagctccaccttggacccactgctgaactctctgagactctctttgttcatacatttgaggaacaattaatgagcacctatgatgggccagacattgttgtagcaagtgacggtaccacagtgaacaaatcaataacattgctgcgcttacggaacttacaatcctgcggagaagacggtatgcagtttgtatgatagcatcaggtaacaagcgcttaaaaaaccacaacaacaaagcagggtccagggctagagagtgatgcaagtactacctgcatctgtgaaatgggattactgtgttgattaaatgagaatatacttaaaacattagcacagatcctggccatatgcctcaatacatggtacctttgttaatattctctccttccaataaatgtcagcttccttccctctaacttccccagccagcaagaaaacatacaacagaacacacacctcttccttgagctcttggccgcagcatcccatgtcaatgacttgctctggccacctctctgcccaggtaacctgctacttgctattacagaggggctgtcggttgcggcaagaatgcttggggcaggagtacaagggggatgaaaggagcacctttcttgggcaccctaagcctccagcagccccaggagccctgggaaattccaggggtcccattagcagagccccccagagaagaaatcactagcatgcccattatgctgccaggaacccttgccagggaagtattctacttggaggttggagacggggaaagggaggcctggccggtgggtgtgatttaaatacacacatcttggacaatttcttcagtgtgtgaacatcacagagtgtacttaaacaaacctagatgggacagcctactacacacctaggctgtatggtatagcctatcgctcctaggctacaagcctgtatggcacattcctgtactgtaggccactgtaacacaaatcactaggggagaggaatttttcagctctgttatagccttctgagaccaccttggtatatgtgcaccatcattgactgaaacttgttatgcagtgcatgactgtaacttcaaggagttacacaggttgaaattaggctgagtgatgatcagatcactatcggagaacctgcaagccagcccttgactgaaggtgtccattacacacaggactagagaagggggctggttcctctttcccatttgccaagcccactctcccctcatcaccaccctgcagacttgctctggcttccccggctgccctctctttcatcaccctgcttgcacctcctctttttcctccccctgttctattccacactccctttacaggcttctctgcctgcctcacccagaggccctcactgaccacttagaactgggagctccacctctctggctggcaggaaattgggtagagagagaggaggtgtatttccgttgttcagagttggagcttgaggttctccctgtagcaatatggtaatgggtggtggataattctataatgctatttatgtgatactcagttagggtggagttaagctggcttttcttttcagcaggtctgggaccctaaccccatgctgagttccaaggaactgaccgccctaaagctgcctgcctgatggtctgagagcaaagtggatcttgcataggccgggggcccaccctcgcccctttctgggccttcgtcttctcatgtgggttggagtggctcttccctaagggtccttccagcttaaacgcacattgtttctgtgactattgctaaagaaaacctgcacccaatctgtctgggacagaaccttgtgcgtgatgtaatttataatcctcttctggggagaattagcattcctgataactgccctattgattatctgatccattgtaaagacttgaagacttgttctggaaatccactgttgagcccaaccagctgtccattagcagtctttagctaaaccttctataatctggcataacaatgactaccattgtttttcctacgaaataccactactaagagtaatctttgaattagcctgctgaagaaaattttcttctagcaagattatgatcaaactttggcatatgcttgtaattaaagaaaagttttcttcagtgtcattcaggagatagtaggtggggaaactacttaaaggtttttgagcaggaagtaatttgttcagagctaagcctgagagtctaaggagatccatggggaagcagagtgcaggatgactggggtaagggacgccgaagtgaggagagcaggtagcaggctgctgtgatagtgcgagacagaagatggcggcttcaagagtggcggggccgaggccctggagaggcgggcatgcgtgaacagccacggcaaggtgaaatcagacacagaaagtgctcagaccctcgtggggtccagggtccagaggagtcagaaatggggctaagtctttaggcctggcgtctggaagaacacgatgtcaggagcacaccagggaagttaggagaaggaaatagtttagggaagttgtgggtttaattttggtcttattcattgaattcatggggaagtgtacttgggtgagctacttggggcaagaaacccctgcagcaagaaggagataggatccttagcacactgtgctgtctgaaggttctgctcactgtggcttgatgtggagagtaggtaccgcaaagaaaatatctccggtccatggtgcctcccaagccaagtgtgtccatagcagcccactctgccttttttttctttttctttccttttttttttttttttgagatggagtctcactctgtcacccaggctggagtgcagtggcacgatctcagctcactgtaacctccgcctcctgggttcaagcaattctcctgcctcagcctcccgagaagctgggattacaggcacccaccaccatgcccggctaattttttgtatttttagtagagacggggtttcaccatgttcgccaggctagtcttgaactcctgacctcaagtgatccgcccacgtcggcctcgcaaagtgctgggattacaggcgtgagccaccgcacccggcccactctacctcttataagaagaagtgctctctgagggcagtcagccaccagaggttagggatggaggtgaggaccacctcttacccatcttggtgcccccagagtacagagtgtggcacccagggagtggcctctgtgatggatctgtttagctacataaaacagaaagatggggacatgaaaacactaagtggcagaaaagatggggctctagtatctttcttccagtccctctgtgaatcatgtacttaaatattatctagtagcccagagattagcaataagttataattacagaataacaatggcagtgacactgcgaagtcagtgtgggaagatctgattgaattaaatacagaaatgacgttgccaccagagttgataagtcatacgaggaaagaagataagcatgggactcaagaaaagcagaaattgagttcttacccagtgctatcagaccctcttccctccctacaaacaaataaataaaaatagtgctggctctcatggcaaaggctaggctgcagtctttagagcaagacaggatgaataaatactagaacaatttgagtattttctatgattaatagctacaattccttttttcgttttgcgtaggtctttgaagcatcaaggttgcatataccggtaagagactgcttttatctgtcaaatctactaattgcccactccgaagaggttgcaattatgccacagtcaactccttcatgttggatctttctctgagaattcactgagatgttatgaatagactgagcttagcattttttttttttttttttttgagatggagtctcgctcagttgcccaggctggagtgcagtggcacgatctcggctcactgcaactttcgcctcccaggttgaagcgattctcctgcctcagtctcccgagtacctggggctacaggcacgtgccactacgcccggctaatttttttggatttttttttagtagagacagcgtttcactgtgttagccaggaaggtctcaatctcctgacctcctgagccatctgcctcggcctcccagagtgctggcattacaggcatgagccaccgcgcccggccaagagcttctaaggatcatgtctgagagtgagtatttctttttttttttttcttttttttgacagagtcttgctctgttgcccaggctggagtgcagtggtgggatctcggctcactgtaaactctgcctcccagattcaagcgattctcctgcctcagcctcctgagtagctgggattacaggtgtgtgccaccacgccccactaatttttgtatttttagtagagtcagggtttcaccatgttggtcaggctagtctcgaactcctgacctcatgatccacccacctcggcctcccaaagtgatgggattacaggcgtgagccaccgcacccggctgcttagcatcttcttgaccaatgagccactccagcttgatacaatggaccatttcaagaggacagaaggcaggccaggcatccccaggggaagagaggtggggttctcttgtgagcaggtcaaagtcagctcaaaccagagcaggccaaggatgcacacatccagtttcatttcaattaaggttatgtaaaagaaccttcagaagttctagtcctgccagctttgaaaaccttctctctgtaagaaccatcccttctgtgttgtttatttccttgagaaaagatattagatattaaagagacatttcaacagatttaagtgttctcagaaaagtgagatgttattcgattaaaaagctaccttagattcatgggtgagcaataaatatttgttgatttgattttcagtcctacttttcaagaagtggaattgaggaggatgttagggaatcatttttgaaagattaaaattagcaaccacagtctcatcttctacaattatattgcagaaaaattgtttattttcctggcatacaaaggagctggctttcctcagctttattttcctctagcgtctgatctacttggtgaaaaatggagaggacaaaggaataacaccaaatacaaagaatattcttggcttaaaaaagaaaaccagaataaacagagagactgctaatgtctctactcttggtaaacagcttatgagaaggctttggaggcaaaacatctccctgccctcactccggcacgtagtttcaatccagtgaaacctcagtaaattgcttcaggaaaatagatgcaagtggatttgcatttaggtgtttcaataacttgaataatttcctcaatactgagcatgacttttgcacccattattagagggggctgaaagagagtggccaagtggcagggttcccggcaggccttactgtgataacagccttcaatcactgccatcgtgatgtgacaaatcatggctttttttggtgcagctgatagctcagggccatgatgtatcaagtacaaacacttgaatgtcaacaacataagaatatttgcccgtaccagttccttttaatgtctgttaaggctctttacagaatccaataaatgtaatcaaagaccaaacaatcaaacaccataaataattctgctgagaaactggagaggccttggccgctgcacactctcccactgccttccccaagagctcgctcgcagctccctctgtcattctctctctctctctttttgttcttccttcctgccgttgtctctatttctaacacatttttgctgctgtgcaacattaatcactgaatattttctctagctttcaaaaacccaaatcaaaatttggttgctcatgggtcccttaacctacttcagtcctaaatgaaaaagactatggaggccgagacacgggcacagggttttaattctgtctcgtctcagaaagaggacagtcttgcaggaaatcatcttactgaccttccttcaggctgtagttctaaagaattttccataaaagctgtccttgaataaacagctcctgccttgcccatttggcctgctgttattctggaaggcttgtatctgtctattctaaatgggtcttttcatctcagacaattcagtggggtgtccaactttcagcagctaaatggtctacccattcctgcatattttcagattttcatcttccataaccacttccataatggttcaagtgagaaacattacccggaaaacccaaaagggaaaaattggatgatgatgttttgatgaacaattttatttagggatgtgggctctactagaatgattctttttttttttttttgagatggagtcttgctctgtcgcccaggctggagtgcagtggcgcgatctcggttcactgcaacctccgcttcctgggttcaagtgattctcctgcctcagcctcctgagtagctgggattacaggtgactgccaccacacccagctaatttttgtatttttagtagagacggggtttcacatgttggccaggatggtctcgatctcttgacctcatgctccgcccgcctcggcctcccaaagtgctgggattacaggcgtgagccgccgctcccagcatagaatgattctttaaatgattttttttaaaggattagacttaggtacattttcaatatacttttatagttttaggtatattttcaatatagttttgcccttcctaatgagaatcctgaaaatatttgagcataaacaaaaaacattgcctcataccgtgatttatttggtatcatcaggcaaaggggcaggttataccattgtaggctattaattaaattaccaggaaaattatttggctgcctgaaccatgcacagtgatcgaacagaagacaggaacccggcgtatgaaggtgctgtttccattttgtgtctggggttccctcaaacacaccctttaaaagcctggtgcaaacccatacgacatgaccatttgcttccttccttccttcttttttttttttttttgagatggaatctctctctgtcacccaggctggagtgcagtagtgcgatctcggctcactgcaacctccgcctcccaggttcaagcaattctcttgcctcagcctcctgagtagctgggactacaggtgtgtgccaccatgcccagctaattttctgtatttttagtagagatggggtttcaacgtattagccaggatggtcttgatctcctgaccttgtgatcgaccctcctcagcctcctaaagtgttgggattacaggcgtgagccactgcacccgttggaccatttgctttctgattggcttccactgtggccttaagtcccccataagacatggctgtgtggcatcttacccgcttggtgagctgagtgtccatcatgaagttatgaacgtgcttctccgctttggtgagttccagctttcgggccaccacggccaccacaagggcagtgcagcctgcaccctgcggggggacatcaagaggaccagaggggaaagaacatatcattaagaggcaagatgagagactcaacacgcctggcggccacgggggtaatttcctgggagtggagtgggaacttgagctctctggctggtcacgaccaagccacaaaaatctgttgaaatctgtcaggactctgatgtcctgacccacagaggggtctgcagtgcctcttgggttgtgctctgcagctgacctctgggaggctgagctagccagtttcaatggagaaggatgctgggtggcgccgaggctttggggggtttaaccaacaactaagcacctggtcagctgccaagctgtgcagcggaagacagaggggccagcacacacgggccctctctccctcaggcaggtctccatcccactgccagctctagaccagcaggcctgggaggaaagaaggtaggccatcagctggggtgcagatggaacacctgccagtggctgagagtgttcctgaaaataatcgaatgaagaggcaatacctttccccagggcttgtttcacagagggcacccaggttggcacgaacacgtgcactcagtgactgtgcctgctctacacttgggctttttcacctcaaggtttacgctatgactcagcacaaggaatcggttccttcctgccttcaccaggaggctcatgaattcaccgtcatgcagagattttaaagacaacaccacttctgctggatcaaaaccgggattttaagtgagcccgcagcagacccttgggattttctggaacagcgatcctagtctgctcggtaggtccgtgccaggggagcccgggggagggtgggcaaggaagcaggctctgctgagcccccagaatggtgggactcactttctctctcctaatcctctgggtgcatacttgactgtctgggaaataagcagggaattccctgcacattccaacattctcccaatgcattttaaaatcctcttcgctaggcttcttggttggcttgtgagcatagggggaattcagagactcactactcccctggctcttcggcaggcagcgggagtcagctccatccttctgcaagcggactcccgtcagagaccatcgccctctgcctgcatgctgtgccctgcgccgccctgaccaccactcatggaaagagatgatgaacttattaaagccaacaaccgaatcctgtatgtcaaacagtaattctagttgccacagaacccagtctagcagttgaggtcccagaatggaaggaatctgtcagtaacatttttggctcatcaggtcttacaaaatgtgtgagaagcagaaaagaatgtttttcaaaggtactataatctataaccgacttggaaggaatgcatatgggtggatccattccctactctctcttttagaagctatttctctctttatcccacaggctgacaaaggctagcctgtgtgaagtttcaatgtggttgaagttcacaatgctttctcctcgtttcccacaagggtccccattaaaacaatctagtgtttctcagtacatttgttggccttgtcacaaagtgaaaagaaccaagtctgtgtgaactttccttttctgacctcattttcctcttttgttcgaggacggctgtgttttttcagcttctgtgacttacaggagactctgtgcccaattttcaaaggatctgggcagttgcacagcctggtctgtagctgtaatcaatttagccatgcctccaaaagcaaaaaatagcttaaaagaagccatcctagagggaagatgtgtgctcccttcccctcgaccggacggagtatcatccctctcctttatatggagttccaaaagtactttgggctgaaagcccaaaaagagggctatatcatagcgttaaaaatggaacatcagatggagagggttctccccaggttccattctccctcctctcgctaggcccaggcaaaactctacttaaatcatccctgaaagctggggtccaataggcctgaagagggagcttccctgttccatgctattttgggaatgtaatcacaacaatcaatcatccaccattccaaatttccagggtctagatggggtgtttcacagcgcttgccatggcccacattttagctggctgattgcagggggggcttttaatgagaagctagagtgttttatctaatgaaccacctgtctcacatgatgaagataaatttctctctggaggcaggacagtggactagatgacacttcccagtttctttcaacatagagatgttatgactcccttgtgagtattcctctagaggatgctgcattcttaacccttaattccaacttaaatggatgctctcagcttcatttttccattgactggatgtaattagggcagtcaccagtaatgacacctaacctggtcttttccattaagaggcaacctaataaagatggggccagacatcagcagccttcataaagtggtggaggaatcctgaagcctagactgctgagcctctgcagactgtgcggggtgcggggcgggaaaatgaagaagggagagaagacaatagaacaggaggggaggggaggagagaggagaaaagagaagagaagaggagaaaagagaagagaagagaagagaaggtgggtgcagggagaggtaaagctgggcagaaaatgagatggggaacaagttgcgttgcatcctaaacagcaagggtcaaggggggaaagagagaaggaggaggctgaagaataagaaaaaatgatgggctgatgggattgagagaggaaggaagaacaaggagcctaaggcttgagccagaagtcaatggtccattttggccctttagaggacatgaaggaagtgccaagggatcccaccctgctgtgtccatcttcaagtggtataaggattgcctgtcccctgggtcccctttgggatgctgggccctttcacttaggtgagttaatagtctgacaggccacagtggcagcctggcagtgctgtgtcacatggcagtgatgcaggttagttttaagagacaaatcaccgagggcctggctaactgtggaatctttgaaatggctggtgggtagagggggtgtgtgaggagggaggaagcaggatgggaaagggtaaacagctgctgctatgacttccctggggtcagactggggggaagagccatgactcagccttttgctttcagatatgccaagtcctgaaccacaggggacatcaactggagtccctggatgtgctctgtccaacttccagttccatggggcgaggggagtggatggggtccacttctgatgagctggaacttcccaaggcacgtgggcgagagggagcaccgagtgcatggagagagggtggctgggacggggtgaacacgcctaactctagagattcggacccaaatctggaccgagactcctccacaccagtcctcccacctcttgttttcaagaaacattttccagctggaaaaccttagaagctggaaaaacaagtatcccaaggggaaaagtatgaggtgttcttaactaaagaagcataaaataaaataaaacacaaatgaaagtgacaaatggaggagggaagcctggaggatttacagttggattctgtttctgcaacagattccatgcaacaactaaaataacatcaattggtttgaaaccaaggtgtttcgggagaagctcatcttctaaaactgacattaagcagatgtcttgctgagccctctttttgcctcctcccgaaatgactcaatttgtgctaccttttacttcatcatcactttcccttggcagttcagaggcatctctcatgaggccattggggaaaagctcagcgtccctgcagatatccagaagcttttgcctgtttgtccataactgatgaagggtctacagagagagtccagctttagaaagaggctagattgaaacaaagttatgccaagcagccttgggggctttggggtcttccagatgcctacagaatcagaaggtcagcattgcacatcttttaggttgcactgtcatttccaattctggatactaaatattgacagctttctctctactgtgttgtcaccatgatcatgaaaaatccttatggaaagatgctggactttaatgtagctgcttttgtgggtgaaatctctcaaacacaccaggtctgtgccagccatggcaagttgttcagacaattatataccctgcttaatggttgataattacattgttactgggattgccaagagaaaacaatgattaagactatttacaggccacacacacacaaatccttcctttcccttcccaagcaggccttgccttggccttcctggtgtccatggtaaccaaacaggaagccctacctttagtaaaggcacttgcaataataattgggagctatacatagtgttgggaggttgggaggaggaggggaaaggatcctcagcaaagtgaaaccctggctaggagtgactcagctagaaaaatcacatttgttagaaaaatgccaccagggttcctcactgtggctgaccccagagtgaggcgactgactttaatttgggtgaaaaacactgacaataaatagaggaaacctccctgttcctgtatatagaaaggtgtatatttatgcacagggttttgtacaaaaagagatgaaaggcctgggctgtatttttcatatggaaggtgggaattggctcctcatcgtccgtttcttctttccactttgatcacacctcaatccacagggaacagaacgctctctctgggggagcactgcacacccagacagcaaaagggggtgctgaaagacaaacagcctccggaccccaaagagaggcaggggtggggccagggtctcgcctgttccgctcagctgtgccagagtagagccaggagatgcggagtccaggaaccaggaagccaggtctttggggtgctgcttcttggatggggacagctatgtgctgagaggggaaaaggtcggtattttaaaataacagaggctcccggcagggcccatccacctactggcaaccctgctctgtgccagccctggctgagagctggttctgaggcacaaagccccaggagtgactctaagaaggaaagatttggccttcagtggcatttcattcctttctggtaagaagcgtctttccccggtttcctcgtgacagttggtgctatgccaagacagactcctactaaccgatgggaggtatttgttctaaagccttgcacttacccgtgatttatcacaaccccagcgctaagctttttgtcattagctgctgtcgtaggacctgcctgctaatagggacctgccctggactggagtcagaaaggaggagagagcctggcccctcctgctcagcaggctgactgccccaagcctgggtctgaccgtctggtccaccaatatcagccccaggaagccaacaagacggagtggggtggggagtgggggcagcccccagccgctgtgaggcgttcactcagaccctgcaggaagacctgcggccctccctttgcactgcagaaaggggtcactgcccttccagaaagagggtcttcatctcttctggaggcaacgggggtgacaaatggaatctgagggatcactgcaaggaaggattttcacaaaggtgtgaggggggctgtggacggggggctgtccttgggagggttgcggtctccagccatggagacccagagccacaccacaagcagcctgaccacttctcaccccgccacctcccccaacactacccaggcttagatgtgctttcctctttcagcctcagtttcctcctctgaaaaaagtgtccaaccctggtctgacactgttctaggattccaggacgaaggccaaagagcagcagctgcctgtcctggacccaaagtgcaatgaggcccagggaacacttcaccaatttgcaactgaaggacactgaggacaccaccaacactgacctgtgtgtggccgcttctcgttttcaaagcactttaacataaatcattgcatttggtccttgcacaaaccaatggggagggcagggcaggccctccatctccactttcccctggaggatgctcaggtccaatatgcagagtgcctggcccagggtccacagtgagcagaaactcagaccccacatccctctcataagccacactgtgatggccatgtgacaggtgagagtgtgtgcctccgcgagagtgtcgagtgtgggtggtagggcactgggcaggagagatacaccttgaaagggcacggcacacctgctgggcacctggagatgggatcacagccttgccaaatgccagtgctgcaaagcacttggcactcagagcccagcccctccataggcagaggtggaagcagaagcctgggaaaggcaagagccagcccagggccatgtggacagccccgtccaggactcaggtcccaaaggccgactcagtgctctttccccagtccctgcttctgtgagttccagctaaacatgatcagaaatggtgccaaggtcagtgggaccaaggcaacaggaaggaggacaataaactgcaagctccagtgctcactggaggtgagcaaactgggtggctgcacagcagtggggtgggcatcagagcattgggccaggaccagcttcacccagcccattttgagggagctgtgaatagaccattaactgccaggagtccaggtctcattcttaccttagaaaagttaactgaaaagtgagaaaccattgcagatttcccacctgacattttatgtgtaggggacacacatgcaggtcggttaactaacagccaccccccgctctgcggctaggaaggcccctatgtgcttgcaagaaagagttcagctctttgccacattttaagggtagggaatggggagaggcgggtactcaccatgatgccagtgaggagacagacacctttcccacagtatgtgtggggcaccatgtccccataaccaatggaaaggaatgtgatggagatgagccacatggcacccagaaagttactagttacgtcctgctggtcatggtacctgccaatgggaagacaggagttagtcgatgaacagccattcctgggagtaagggctgtgggcaaacctagagcggggaaggaaatgagatattttgctgaggaagaggcagcagtgacggtggctcacacagatctctttaggctactgaaggggctgcaactgtgcccacccaggtcccacctgcagccccccgtcccgttggcctcccgccatgagcttggtcccagagataaaatgttttgtcatgatttgcacctcattgtagacatccttttagtgttggtaagatagctttggatgaaatcatgcagtaataaaattcaaattttcccttccaagccgacagtctaaatgtatgtggatgtgattaatctgaaatcacaagctcctgaacagggaaaatgtcaaaaaaaaattaccaaacatattcagcgatttcctctaagaaagttgaagcatctcaaagactggcatctcccgggggtctggagggaagctgtggtggttggggctctcgtggagctgtctctagagggggctctggggtgtccacagaggcctccctttctgagtcagacaggggcttgtagctgccccgccctgggaggaaccaactggaaacatcagcaccatttcctctgcccggatgcctattccaccccatccccttcctccctcccttcatccccaacaccaagacctgctgcatgccaggctctgtgccaagtactgaaatacagagatgaataccacacagcccctgccctcagggacccagcccaagagaggggtttgccaaggaggcagacatctgcagaggggtgcaatcagggggtggacaaggtgccctggggatggaggcagagggcaatgaccttgacccaaacacatgagggtccacagaggtgccacagaggagcaaggcttgcattttccaggcaggcccagaggaacgggtgctctgggcagagaaccctaatgaaagcccagggcttatacaaagtgcagcaagggagctggttgcaggctgggtggcagggctggtgaaggtgagtcctcttccaaaccgttctctaatgggatcagcctgaacaacacacaatagactctgtattttatactgtagggcttcacctcttgataaaatctcctcttaaccacttggaggccactggatggggaaagctaagaacaaagggccagggagaccaaacctactaggctggatagagcagaaaagccatttaggaaccttaatctatggaagtcagttaccattggggcttccgtgagttaatgcacacaacgtgccgggacaggcctagtacaaggaagccccctggaaggattcgctgccgtcatcaggaatctccatgcccccacagggtctgtgcccagcgagtgataggcaaatgctgcttttccttcccttggcgccttaagtgaggcgtgcagggcaggctgcatgtgtagatgcatctagagatgggcctggaaggagacaggagctcagccagtcagaaagggacagggccatcaagtcagggagcagcaagagcatggtatgacggatactgtgcatgtattgagcacctactgtgtggctggcactttgtacgcaaacattctcatctcacaacagtctttaaagtatttcccaggtaagcagcaggaggcacggagacactgggtgacttgcctaaggacacacaggaagcaaagcccatgctcctttcactgtttcactcaacatcagagaggcaaaagcgactggcgtgtgtcttgggaataatgaggaagcttcagtgagaggagagcacctgggctccagtagcaggtgaccagggggcttcagagaccaggggtcagatttaggaaggcctggaattctgggagaagaagcttggatcttgtcttagaggccttagaagagattctgggttcttgagcacaggaatgacaagataacacagcttgctgggaagaatggtcggcgggtggcgagcagggtatctgaagagacaggacacagaggtggggtgaccaggcaagaaacaggtgtgcaaagctgggacagagacgcaggccacagcctttctcacccaccggagcccggccctagcagattcccgcgagcacatcaatggtgggctctccagccccacttgagtccttggccagcaactggagacccagtgggtggcacagcattagcctttttgtggctgtctgcacaaggacatgggtgtctggtacttctggggacatctgaagaaaagataccccctccccaaagctctgctaatgagatggccttgcctgcccactccatctgctatacttgctccccagggatgctctgttaccaccctaggggcccctggctggctgcgtgggcctcatttccctgggctgggcctgcctttgctcccctggctatccttgagtagcacaggctggtggctcccaactctgattcccaggattgcgtctacccctgaccgtgacccagcgcatcagccccctcccagttctgctgtggccttggaaaggcagctgtctccctggcctgctcactctgccctgctaggccctcaggtcaatgcaacccctcccttcccagcaggttgctttctggctggagggatggtggcagaccctatcctcaggccctgtgctgaggcagtggtggaaaatcagactttagcttctctaaagcagcaagactcagtgactgtgggaggggacacagaagggagaagacgtaaaggcagctccacgccacaagcctgcaacacataaatgtaatacagtcacagccagggtcctcagttcttccgaaaaacatttcctggaagataagtcttgggtaaggtctgaagaaatgtggttgaggcagtttagcagtgaggagttgagctgagccagtgatcttgggctgggctgggcttgcctggcttggagctccagctccagagttaagtagctccatggctgtgggcaagtgacgtgccctctctgtcaatcaatttccttatccaatgatgggaggattaagtaaaataacccacaagcaataccagcacagtgacccaaattaagtgctcactaaatgtcagccattattgttgctgagagggcgcaggtgttatcagtctgagaaacaatagacagaaaaatacaggggcatggatttacacgtgcagtggagtggtgaggcattcatgaagatgtcttgaagtttaggctggagaactatttgatacagacacaaaagaaatcaactgtaagttcttggacaaagaaaagacatgagatacttagtatctgaaaatgattcttctacatgaaagactgactaaaggggtcaggccccagataagcagtgctgctagaagctttgcaggtgtccagggagaagcaatggagagccttgaataccgaaccatgaagttaggattaatttgtagcctgccctctgtgcacatcatggattttcttgtgcacgtgggtctccacagtcctcctttccctgcaaaccctgaggattaaactcgtgctccctggctgtttggctgcccttaggatcatggaccatcctattcatatgtgggaggatgccaaggtaaagagattagagatcaaagtggaattacatataaattatgttcttgtgggtttcttttttcattcaccataataaactcctgtgcgtgctaactgtgtgtgctgaggagaggagtgaagatcttgagagtgtccttcgttgtttgtcagccttcagtgatcgcttctctggtgggggctacggaagatgctgagatgaattggacatgcaccctgctctccagtggcttggagcttcgtcatggagataagacatacatgcaactcaccaagcaggaagtgatgagccagaaggctgggctggtgattcaggactgtgggagtagagaggagggagaaaaggtttctaaacctattcacaattttagagcggtttacacatgtcacaaactcacatactaatcttgtgctattttttgcaatagaaaatttgggggggggggatagctccatgtttttctttaaaggctgaggaggaaaagatgtaatttttctttgagctcaagggtagttattacagttactgatttatctttcagggtgtggactatggattttttttcacttcttaacatgaaataaatgagagatacaaaagactgtatgacttggcaaagatggtagagacatatgtctacttttgctcactcaaatcccttacagctcaaagttgttagtctcctacttttaaaaataagcaggcaaccaggaatccccagacagtcaggagtctctaacatgaaagacacagatcaaaccagtcaactaaacaaacaaaaagaaggaactctggatcaaatacagaccattcacagagagaactcttgaaggaaaaatcctataattaacgtaagagagagaaaataagatactggacccacgagacaagaatggaatgctgtatgaaaaaagtcttcctagaggggctggaagatgataaatcgaggaattctcccaaaaagcagaaaaagacaaagaatgaaaatgaaagaaaatatgaagttaggcattgtggtgtgtgcctgtatcccccagctgctcggaggctgaggcaggaggattgctcgtgcccaggaggttgaggctgcagtgagctatgattgtgcccctgcacttcagcctggggacagagcaagacccccatcatctcttaaaaggagagagagggaaagaaaatatgagaaaattagtgaatcagtctcccaattcaaacagtagaagttacagaaagaaacaactggggggaaaagaaggagaaagaaggagagaagtaattattttaaaaatcattcaaaaacaaaaatccccagaacttaagggcatgagtttctagatcaaaggctcactgtccccagcacagtggatgaaaatagatgcacaccaaggcacattattgtgaaatttcagaacaccaggggaaaggagacaatcctacagagctttaggggttttgggggagggtataaaagaggccaaatacaaagaaccagaaattacaacagcttcggactttttgacagcaacactggaagctagaaggccatggaataaagccttcaaaattctggaggaaaattatttccaaatcagaattccaaaccagagaccagaaatctgaattggccaaagtattagttcagtctgagggtggaacgaagacattttcagatacgtaaggttgtcacgggtttgcctcccatgcaccctctctcaggaagacacaggaggtatgcttcaccaaaacaaagaagtaaaccaaggaggaagacaaggaataaaggtaacgagctcagggtgatgctacagggaggccctcataggacaggtgctcaccaggtgcggaggacaacccgtccgggctggagcaggtcaagaggctctgggagacacttccaaggagatgaaattgataggaaacttaatgtgcctgaacatcctgaaaagaggtttagacaactgccagagtttgcacttgcattaatgacgaatacatagaaaactaagcaaacaaacaaacacgatcattaacaactccaggaaaaatgaaaagttctgcaggaagggaaaagttatcatattttttactacaaggctcaactatgaatagagtcaaattagtgttgactgagtaatgtaaacactgattactgctttaaccaaaattatgatgtaattataaaaggaagatgaagggagaggaagagttggaggagaggaaagggagctaaattttcatctcccagagtgggaagggaatagataatacctaaataaaccaaagcatcaaaaggtagcaatacacacatattacttacagacatggaggtaaatactaaaattaattagcaaaagaaggtaaaagtagctgcctctggagaacagtaaatgggaagagctggtggaagacagcaaataccacggaaggattgactctacagtgtatgcacatgtaactttgatcatatcaacagaacaccaaaccaaagagaaaaaacaaaactacatgcaacattaaatgacatcaagaaacacagaaagaaaataagcaccatgaactcaccatccagctccaacctgtgggatctacttgtatgttctctccattcttagtgccccccaccccaggatcatcattaccctgaatgtcatgtttatcatttcctcgtttttcttcatagtgcttccatgtaggcaggattacctaagcaatatgtaatttcatttttcctatttccgaccttcataaggatgaaatcataccacaagagtatggtaggaagcttctaaaatgacctcgatatcccccctcctcttgaggtcttcacacacttttgcaatcctttccttttgagtgtgggctggaccaagtaactggtttctaacacatagagtatggcagaagtgatagactttcatttctgaagttaggttatggtaagatcatggcttctgtcttgggtgatctctcactagttatcttttggatcactctccctgggagaatccacaggccatgtcgggaggcaagcccgtggagtgccacatggcaagggacacagcctgccaaccaccacatgagtagcttagaagcaggtgttctttaagtcaagccttgaggtgagaccacagccctggctgacagcctgacaatctcatgagagaacttgaggcagaggtacccatttaagctgcacctgaattcctgacccacagcaaccctgagatggtaaatgtctgctgtttttagctgctaaattttggagcaagttgttatgtagcaacagataactaatacagtgaactcttctatgaattgcttcttttctgttcaacatatatattatattgacatatgtagctatagtctatttttattcctgtattgtatttcatcatatgaatatggcatgatttatttattcattcacctgttgatggacagtgggatagcttacgggtttttcctctaatgagaaatactgctacaaacattattttttattgacttattgttattgtatttttagagacagggtcttactctgttgcccaggctggactgcagtggcacaatcatagcttactgtagcctcaaactcctgggctcaagagattctcctgccttgacctcctgaaatgttgggattacaggcatgagccacctcacccagcccaaacattcttaatcatagctcctggtacactgcataagagtttctctaggacacatacctaagactgggtttgctggtttgtaggatatgtacatatttcacttcattaggaaatgtcaagttgttttctaagatgccagtgccaattaggcttccaccagaggtggataagagttcctgtttctccatatcctcattaacacttgccattgtctgactttaatctctgccacactagtgggtgaattgggatctcatcaagacttgactttacgtttccatgataaaagcttaagtagcctttcatatgtttctttgtcattcatactttctcttctgtggcgtgtcattcatgacttttgtccacttttctattggcttgtttttgttttttctcattgattctaaaagttatttatatattctagataataagaattttgtcagtttgtgtgttgcaaatatcttcttccagtgtgtgccttgcctttttctctacagtatttttgatgaatagaagttttaaattttactgtaggtgactttatcatcctttaatttataattagcagttatttggtttttgcagaaatcattccctccctgagattgtaacatttttacatattttaaaatgttgcctttctaagtcttcaatttgcctggaattgattttgcatatggtgtgaggcagggatacaacttcatttttttcacatgggtaagcaattatctcagtttcacttaatgtgcagaccatcctttctcctactagctttcaatgctccctctgtctcataaattatatgtggaagtggtactatttcttggttctctattctgttccattggtctatttgtctaaccctgaagttatattacagtattctctgtagcctttccttggtaccttctgagggtctagcacataataggggctcactaaaatacttgtggactgactaaggcctgcatgctgcttttcctgtccctctacaaaagtgaggcttgcttcagtaattcagtgaatcatgttaaaatgatttcagctgttctcttcagcagattaaacctttgtcaaggtggctgccaaattccttgagcttggagtcagttctcactattaataagaactcagcttcatgacactagctgtgatctgttacagcactagggtgacagaaaataagccaaagtgaaatgactgcctcttcttccttattctccaaaagaatttgaatactttttaaaactagttttgtaaaaaaaaaaaaaaaaggattcttttcacatggatctacatgatatgacggctctagccatttgtcctgggtctgatttgtttgttggaaatttgcaggcattgagccagatcctctgcagaactccaaagcagccaaatggactgcttcgtccttgccttccggtcaatcttcagagtcacacagtcagacctgcccactgagctgtgaaccctgtgcttgcgaatttctccaatgaggaagccaacaacacgtacctggcttggccccctggcggcctctgaccccaccggtgcctctctcctcggaacactgccctcctctggcatctgcagcggctcactggcctgctttcctcccgccttcgactgtgcctccttggcttcatgctctgaccaccgcttcagggttgctgtgctccaagcttgccttgcacacatggctctcttgctcctgtcactcctgccctgtcctccctgatgccttctaactggcccttcaggacccacttcaaatcccatcctgacccacccagccaaccccagctctttgcctgtgtctcccacacgtggcatcagcaccatccacctactgcccacacactggcttgcagaaaggccgcaaagctggctggggtatagctgaacctacaggttccagggccagaacacctatgtttgaatccgggctttgcaccttaatgtctgcatgaacttatcctcagtcttcccacctgtaaaagaggataatacttgtaccacctcacagagagttactgtgagggttaaaggagctgatatgtctaaaatgattagagcagtgccgggcacataggtgcactaaaaaaaagtgctattttcatctcgtgtgtctatggttagccttggcatagcagaaagaacacaagatctggagcccagagactgcctttcatgccaaatggctctgtgaccttgagcagatcactccacggactcagggcctgctgcttcttcggggaagcagggtgtaatgatgccgtcctgcctgcctcgcgaggccgcggtgaggagtgaatgtgcacgggctccatcagccttcagcaagtgatacagatagaggtatgtcacagcctctgcaggagcctctcacctggggcttcgtcctagtgacaagggcagctgcacggatgtggagaaagaacaggcagcagatgctgctgtgtaggaaaacagaaactcctcccagcttctccttttaatcttcgctgttcttctgggtggctgcagccccttctcttcatttggtgacttgcagcttaaaccccttatctccatcaaattctgtcacctctgctttcaaaatatctccagaatcggagcgcctgtcatccctggtctgtggccaccctggaccagccccaccctctcaccttgtccagccccaccctctcacctggaccagccccatcctctcacctggaccagccccactctcttacctgctccagtcccatcctcttacctgctccagccccaccctctcacctggatcagcaccgccctctcacctggaccactgcagtagttgcctcactggcctccctgcttctgcctgggcgacgcttgcctcaggctagtcctgttacagtagtcagagaggccctctaaaaaaagtaagacaaaagttcctgtatccctcagaaaaaaagccgaagtcccctggggcccccaacctgggggcctctctgagcccatctcaccttcgcccattggccctgccacctggggtttctgcagctccttcacccagccagctttactcctgcctcagagcccctcacctgctgttcttttcagagatggccctgacttacaatggtgccactttacaatggtgcaaaagcaatacacagtcggtggaaagcgtacttcaaattctgaatgttgatcttttcctagggatctgtgatgcaattctctctcctgatgctgggcagctcgcagttaaccaggtgatcatgagtactctacaaggtcctctacagggcactgtgctgccgggtgattttgctcagcggcaggctgacataagtgttcccagcacgtttaaggtaggctgggctaagctatgatgctcagtaggttaggtacgttcagtgcattttcaacttatgatattttccacttactgtgggtttattgtgaagtaatcccatcataagtcacgggacatctctacttagaaggctcttatcccagataatttcaggcctttgcacaaatgtcagcttctcagtaaggtgttacccgcccaccctgtctccaagtgcactactgccccacacccagcaggccagcttctcccgagtcattcttctccacagcgcttatcaccacctgacataatagatatgtggcctatttttgtatttattgactgacaacccctattacaatataaggttcatggaggaaaggactttttctgttttctttactgctgtatccctagtactcaataaatacttgtccaatgaatgaatgaatgaatgaatggctccacttcgtctttctcacaagccagtgggacaagaccagcaggataagagctgttacctgattttacagtgaatcagtgcaaagctccagtgcgtaactgacctaactaacttctcacagcaactaagcgaaaagactgggactgaaacctgtattttttcggctgctaaagatggcaattgtagtgagctgggcacagggtggggcgtggaggcagcacccgtgtgcctgggcaggaaccattctagcttggcaaaatacccgctcagccactgccagtaggtgatggccgggaggctctgtatgtgactggcattcgaagctattagaagcctgaattagaagctattatgaaaggaaagagactttcatggagtcctgggttttattcccattcccagctctgcctttgtccaggtccccaatataatcaacttctaattatcaagtaccttcagcatgctagggcatgtgattccagctttatggagaaaatggggtgaaatcatcatttcttaagggtattatgagttcctttagtttaggagcatttcagaaatgcttgaggcgtgtgaaagaatcccattgaaattcaaaggcagctgaggaataaatggcctagggtgacttcagggctattactgcttgtgccagtgggtgaattcacattaaggcaaaaaaaaaaaaaaaatagttcgttcttttctcaaaaacaatttcccttataaacatcttaaaatgtaaaataaatggctttgaagactcagggctgatcacaagcctatcaaaccacgtgcccaggacaccacatgcatgtataaagccacccctccatccacttcacctctgtgtcctatttttcaagagttggctttgaatttaggaaaataacgacgttttcctctaccaggtaattcaaggtaacagccctggatctttccaaggcaactctaaatctagtcttttatttccagccctaagaactaacagcatggtgcaaggcctccagttatttttaaaaggagagaaaaccagcaccaccagagcacaatggctccaacaaacaaatgcgacttgccgccaaacaaccacagcttgttcttgctctgtgaaaacgagagtttggttggtgtggctttttctcaccgaggtggtggcatctctgtctccattagtggtttcctgtagaagcttctgagaaactctggaagaggtgggacagctggctggtgtcacacagctggatgcaacctctgcaggcctcagcggggaagcttcaacaccagcactggccaagcttttcttggagtgtgtttctcttctcttgggtctcttggtcttgctcaacttctccaccttgcaaatggatgcaccatttgagggaagccagctgccattccttccacagtccattttcttcttagagggaagcactgtcaacctctttgaaattaaaaaccagatggctcatctggcaaatccttctgagtcagtttctcaatttgcaatgttttctttcttcttattaaaaaaatatttccatgtttcctgatttggaaatgtttaataaaatgcatgaaaatggagaaaaataatatgcttggaagaagcactgttcccatgggaagcatgtcttccacggtatctggagatggcgtggcagagatggcatgggcagagagtccaacagacgggggtttggatcccagccctgccacctgttagctgtgtggcctagggaaggcgcttacctctctgtgtcttgggcttcacttctgtaaaatgaagcagtaaaaccttgcacgggactagtgaaaaatataaaactctgcatagtgcctgacacaaattttggaacttagtaaatgagttcatttggtcagcaataggaatgagccccctcctgtgtgcctggcttggtgcctacttgggaacttagagttctaggaagaaggcagacaccaagcaacaccaaggcaaaaaagggccgcgttacaatggagacaagtgatgccaagttggggcacggggccactgcgcaggggacacacggctatctcagaggagcaggtatgggttgggatgacagtgctgcgggtggagtggcaggctcaggagaaggctgaggtgagttggagggagaagcagggcggggaaagaactctgagcatcttctcaaagttgccagtgctggggtttaataagcagaaccccgtgaactcacaggcacagctggcctgcactgttactcttgccccaaacccctccatcttcttcctccttctcctctatttttcctgcctttgcccctctctgttctttcttcttctctttcatgcttctttttctttttttctcctttgaagcactgtctccacctccctctcatctctcctctcttgttttccctttcacttgttcagtctctctcccaccctcccctgtgaggacccacagaggaagctctgccctagagggaaagggtttctgcctccaaggagctggctatcccttggggacatcagtctttgtttgcttcaggttgattttgcttaatcagcaaacttgcattttgcacccactgggtggccagatacagatggcatcaaatgtcaccaggcagaatcctgtgctgtaaagtggggagggtaacatctggagtaggtgcatgggtccccccaacgtgggacatctctggaggggtggcaggtaaactaagctcaaccgatccccaactctgctcattacctgccctctccctgctgcccaggtcccctgcaaccccggccctcttcctcctgcacctcctattcgtgggcagtcccaccagctatccagccagccacactaggacaccagacactgttcctgagcttcctccccatcactccacatccagtgagtcagtccggtggaggttggctcctctagctctctcaaaactgcccttgctcttcatcccagccaccactgtacccaggggtggtgggggcagcattctgttactacagcagcctccccagctggtgtcccgtcttcccctcaaatcccccttccacactgcagccagggaaatctttctgaaactccagaccctcccctgctcccaatctaccagtggctccccctctcctaggtgtgggaagaggagaggggacgttctcagcctctgcacagcgacacactggggcagacaaacagtctctctggggctaatagtagttgaaggattgacatttgtgaacgatttattttttttgttatggcagtttcaaggctatcctgtgataatatcactctcgctatctggtactctgatttgctttcttcagtggaaaggaagggccgggactccagctagcctgatggaaatgatttataacctggggcacacccacagcagaagtcggctgtctgaatatcatctctcctgcatcgctggaatcaaagaaacaagtacataaataaggttggaaactgttggctgatagaagagtcattccaaaatccttaggctggtgaaaaaggcccgtgcctgctcctgtagcgttgagtgcactgccgcatcttatgacaccccagcaagcaactgcttattctctcctccaatccatgctcccccacctccgagcttccctcatgctggcccctctgcccggaggccccttaggcctaggaaatcacctcctccggaaagccgtcccggatcaagtgccctctgtggagccccttcttccccattctccctcacttctcaccaccggctcttggccatctccacccccagcaccagcctccattggttggttggtttgtcggtcggcaggtgctgagaaagctggtcagagctactgaaggaagctgtgaatgaacaaggacttaggggaaagtgacgtttaaacctggtctcatctcactccctgctgtgggcctctgctttctgtttaaagccattctgggtctctgcttgctctcacagctgctgtctgtctgtggttttcattgagctccacccgcccggggccctcagtctgccgcccgcgcctgcaagctttctctctcctggttgagcctttcccgacatctgccatcagtcacagagcgtgacttggaagcaaaggggcttcacagttcatcgttttttatatacagagagaagaacaacagtagttgggattcttgcaaaatacttcctcaaagatcttagagatgatctacttctcatttcattttatttctggggctatctctgtgtggtaggtaagactggatgctaatcttatttgaagagataacaataatcactatcatttctcaagtgccaatcacgtgccatgtgggccaaagctttatgcgcattactgaatttaatcctcaaaaaacaagactcataactgtcacttcctattttactgaattggaaaattagaccaggtgcagtggctcatgcctgtaatccaagcactttgggaggctgagacagaaggatcccttgagcccaggatttcaagaccagactgggcaacatagtgagatgctgtctctacaaaaaatgaataaaattagcagggcatggtggtacgtgtctatagtcccagctattctggaggctgaggtgggaggatcacttgattaattactagattaggaaacttgcacaaaataaaacatcaattgagtggcagggcccgagtgtgtgcttggacttgcctgcatccacagccctgtctttgaccatattgcaccttggaggagccctgtctttgaccatattacaccttggaggaggtggagacctaaaaagggaggtgagatgagtggagagactggtggggattctctctctctcaggtatctcatcctggatctgtgttataatgagccatgcttcccaggagagtaagacagagccagggctgccctgttcagcagcataggttgcgcactgtgcaactccaaggagtgccagtcacgaagacttcaatgtgaatggcaccccctggagggaagtgctgcataggcagtgctcctggcaagagccctaaagaaaagacgggtgtcttgctcttctcagttatgctttccaaagataattaaaggcaggcagctccccaggcaagcaaatgttgtggaaggcacacaaagctgcagcctcacctaggcagggttagtgtgggaaggacgtgggaatcaccctgtgaccaagaacaaagaggaacagcacagaacaagtaccctgggaaggaattttcttgtttttgtttcccagagcagtggggttcccagggcaggacgtgggagctctggttgggcgtctttccctgccacagagaagacagggtgccaaggaggagcctgggacgtcagggcgagtgggaagaattctgactcagcagaggttgcaaagtagcccccagggaatcagagagagaggaagatagagaaagagagggacagggatggagacagagacaatggctggaaggggaggagtctgagggcaagggcacctgggtgagggtctggcctgagcatgaggggcctgaggacagggatatgcacaataatgccctgacccggggtccccacggccgtggggcttggggagactacgggatgctcccggaccacaagcagcctgcccagggagtgcagctgtccctgacctctcgcctctttccataggcctgggctacgcagaaaggcacatttccctgctttctgggagtgggctctggccaagtgaagcgtcacgaagtctgggatgggagtagtttctcaggggctggtccggccccaactgcccacagccaagtcacctgagccttggtttacatgattaactgaaaattctggtacacgtcaggaataaagctaattccgaaggtcaacactatatggagaaaggaatggagacagccagtcgcacacacttttccctcagaagggcctttcttgctggagaagcttctaaagcctcgaagctggtgcaccccaagctctggagagcagcggctggaagggaaggctccaggcctggtgctcaggccaagggcctcctgcacccctcctcacccatttcctcggccccaggagcagaatgaaagagatatgaagagacagattgccttcagcaatccttttctctgcctcttgaactgagagattcttacttaaggaaaggaaggagcaggataaagagatgacccatctggagatgccttctcacctgtggggtctgaagggaatagagcaaaacccccttcgcatcaactctcacagctctgggcctccctctcttcatctgggaagggtggggggctgggtccatgtgcattagggccccttccagctctaaggagctgtaattctcagagaatgttttcttacccgtttcccacactagatggagagctggttaggtaggggagtgggcagctgcagccctgatccttgataagggtcttaagagaccatctttgaagacacagatgcccaggaggcttgccctaaatcagcctcatggtgacaagtgtcgtggctgtgctcggggtctctgcatacagtgggattctcctggggagcatcagctcagaggcccaggaccccctcagcttctgagctttcctggggcggtgagagcagccctggacacgtggctgaaggcctgggcagcaggggcctgcctgctgtgtcagctttaccatcagagtcactgagtcttggggctccctctagcccagttcacctcattctttttagataagcaaatggaggccagaaagcggagaactgggcatctggtgcacttctcaccacatgctgcctctttctagccacagggcatcagatgtgtgagctcggcagagtccagtcccaggagagagacccttggctgggagctcagacccgcccaactcgcggtgtgagtctggacaagttgcttcccttctttgggctttggtttcctcgtgtgtacaatatgaggatttggctaaagaagctctaaagccccctccagctctaagtcaggtgtttttttggatcacattctgtcccccttctctctcccactcccattctcgggacaactagcagctgggctgactgcagaggcaaaagccaggtgtctttccagacaggaggcctgtggcatcccgtgcagacaagatgaagcaagagtcagcaccagtggaaaccacctagcagccttcatccaggctggccatgcctcagggagctgcagcaggtgcctctcaagttacacagaacttctgatggctcctaacccaaggcttttcaccactggacacctggggtgcctgaaatggggcaggagagggcgtgccagtgccaaggctattataaaagagtaagaatggcaacactcagagtcaccatggaagccaacctgtctgtctgtccccctcccctgactcctccccatgaccccagagaagctcccagagactccttcgtccactgcatccccagcctggctctgttttaagggaagcagccaccacagaagatgcttgttacacgttgccaggcaacaaaaatgctgcctgaaaactaaaacccacctctgactcttcataggactggaaactggcagatgagaggagcctgccagggaacaaaggagaagcatcgagagggaaatgatggagttgagcaaccacagaaggcaaaatgaaagagcccagacagttgtgtaaagtgccagaaagcaaacagatggggaggaaaaactgactcactgaaattaggaagacagacagagagaggaggcatggaggaaagtcctccgggtgttaagtcctcgaaaggcctcctttattttttttctttttggccaaatctgtcatgagtagagatgaggctgttgataaggaagatgatgacaatgatgacgatgatgattccttaggtgaactctggtctgcttttatccagtgcgtgatttttattagatatccctcaagcaatggcacaattctccacagactttcagaaaacataattatcctctaaaacgaagatctacactgccattagcaccatcagctcacccaaatatagggacatcagcttgttagctgaagtgaccttgggctctgggatcttcaagcactgagcagatgaaggaaggaaggagtgatgttcagtctggacagccatgcccagctggcaagggaacctcggagaatgggagtgctccaggtggaggactctgcgggcagcagccccgggccagcagtgagaccctggctcgcttacctcccaaagcctccatttcctaatttctaaaatgggaaaattgctcctgccctgcttacttcacagagtgctgggccacagaggagaacctgtgtagaatgaatggccatgaacgaagatagtgctccttatttattaaaaaacaattcctagcctcctacagaggctgggcactgtagcagacattatcacacagacatgccccctgctgggggcgaggcaattaagcaactccacactatggtgggggagttaccccactgctcttggcctcagtttttccatcagggaaatggagataacaccacaaagcattcctatgaggacactgcatgtcagaagtttctcctccctcggcctgtggtcacccttgactaggctccgagcacccggctcagactcacctgcctccagttctgcatcacgtggcctcagggacaggccgggcacctcaggaatctatcctctaatttctgaaataatgaaaagcctccagacacatttactctctaaataaaatgcacagtttaaattataaacaagacaatttaagaatactggtaactaagtgggaacaatttcacatgttaaacttgacaaaataattctaaagctactactcagttaactatattcacatctacttaactcagtaagtttgacaacatagatgtttactttattaagtttgttatacattttctccaaaaaagtctagccagtcaccagaccccaccccacccctcgaaaacagacatcatggcattcaaggacaatgagccgcttctgcctgtacttactaataggcagtggcttccccctaaaaatcactgtttttctagaacaccaatcacaattcctttcctaggtaccaaacagcatgacctcaaagaaattagaaaatgactgcacagtccaagctgaaagaaaaactttgcgtcttatgttctttctccttttgtctcaacacagactcactctgtaacacacctccccagtggaacacataccccaaaagccctgccacaggcgatcggggtcccaagggcccaggcctcctccactgccctacaagtcagggccagggcagatcatgagcctccttgagccaccacatcctcatccacgaaatagggaccgtgggttccccgtcctgcctgctcacttcatagggtcgtggtgaaaaacagaagaggatgtccagtgttttatgtttcccccagctgttcaggtctcctcttgtttgaacttcctaatcccctgggaagcaggtagaccaggcttacttcctatctacagatcccaagaaagaggcccaggaaaggaaagggctcagggtttatcaggaaccagccagtcgcaggtgcttatttaatagagggcaggtgacttgcccaggatcgcacagctggtccgttgtcaagccaggctatgagcgcacgtttctgactccaggggccatgtgctgtcccttctgtgagcaataaaaccttccatgtaggaatgcaaagtatcattattaccattgttgctgatgttactaaaattgaaccaaaccggttttatcatgggttgactggaattgcatgatggagggccttggtcactaaatttaaaaatatggacttaatcttctagagggagcaattgaaggtttttgaggggtaatagtaggaacggtaactggaagccagaaaagctacttctgtaaactggtgtaagatgacagggatctgtgtcagggaggtagcaggaagagatgacttcaagcgacaccgcagaataagaaccatagagcttggtgcctaaatagagggctggaaatggggctgggagtggcataaggatggggaacgatttgagcctgagagatggttgcagcccaacagcacgtctcctcttcttcattagtaagagcgcccaggaaggagcaatgattaccaataataaagactacattttcccgccatgtgaatgaccaacggatgtaaatgaaagtgacatgtgttacttcgaggaaatgtccttaacaagaaagaaacaaccttattttgtccatttctctttcctgatggctaaaaggtaggtgggatggctggagctccagcagctttcttgaagtatgaggaagaagccacgtaccaacgatggcagggcaacaagggagaaggagcctgcgtccctgatgatgccatagagcagcatacctgctatagacacctttccggacttctttggcgtcagacagaacttctgttttgtttaagctattgttgttttgggtttcctatcacttgcagcctaaaacgaatactaacgggtaaagttcctgagaaaaagaagacacaaacagagaagcagagagagaatttaggggcaacatgatgagtttgatcacagatttgatgcgtgggacatcagtacaggagaagatgtatataaaacttggcatggtgcagggatgtattcaagaactctacaccgccaccaccgcccttctaagtcacttttgtctgttgcctggcctgctgcagtagcctttttagtcctcctagtagttttcttgccacctccaatttactcacaaagatgccaaagtaatatttttagaagcaaccatattgtattactctcctatttaaaacccttcaaaagcaccaggcatggtggctcacacctataatcctaatacttgggaacctgaagtgggagtattgcttgaggctgggagtttaagaccagcctgggcaacatagagagactctgtcgccaaaaaatttttgtatttagccaggcatggtggcttatgcctgtagtcccagctactcagagggctgaagtgggaagattgcttgagcccaggagttaaagcctgcagtgagctgtcatcatgctattgcattccagtctgggtgacaaagtgagacaagaaagaaaggaagaaaggaaggaagaaagggagaaagaaaggaagaaagaaagaaagaaagaaagaagaagaaaggaaaggaaggaaggaagaaagaaagaaagagagagagagaaagaaagaaagaagggagggagggagggggagggagggagggaaggaaggaaagaaagaaaagaaagaaagaagaaaggaaggaaggaagaaagagggagagagggagaaggagaagggagaagaagaagaggaagaggaagaaggaaaaggagaagaagaaggcaaagaagaagaaggaggaggagaggtggaggaggagagagagaggggaggaggaggaggaagaagaagaaggcaaagaagaagaaggaggaggagggggaaagaaggaagaaggaagaagaaggaagaggaagatgaggaggaagaggaggaagaagaaggaggagaagaagaagagaagaagaagaggtggaggatggggaggggaggaggaggaggggttggggaggtggaggaggaggaagagcaagaagaacaagaagccaaaggcaaagaagaagaagacgatgatgaaaaggaggaggaggaggaagaggaagaggaagaagaaggaggaggaggagggggaaagaaggaagaaggaagaagaaggaagaggaagatgaggaggaggaagaggaggaagaagaaggaggagaagaagaagagaagaagaggtggaggatggggaggggaggaggaggggttggggaggtagaggaggaggaagagcaagaagaacaagaaggcaaaggcaaagaagaagaagacgacgacgatgaaaaggaggaggaggaggaagaggaagaggaagaagaagaaaaagaagaagaggaggaggaagaagaagaaacaacaagtaaataaaaagataaaactctttaaaggctttccactgcacttaggttcaaccccacaacatggcactcagggcccttcactttcagcctcctgcccccttctgcggctcagtccctgccacaccccccttcatctgtttactctccttccagtgactccttccccccggctccttgccagctcagggccttggtgcagtcttctcattcttctcagaaggctcaccctcttggtctgtgaagggctcatttcctctcatccttcagacctcagctgaagcatcacctccccagagacacctccaagcaggccccagatgagtaggatcccaatccaatgccataaatttttttttaaaaaagaatcattgcaaacttcttttttccactttcacagtatatgtcatagatttgaaattatctactttttgtttccttacttgttacctgtcttccctggtagactgtaagcccatgagggaaaaaatcatgtgtgttttatgctttaagatatatttaattcctagcacagtgcctggtgaatagcagagctccacacctatacataacagtattattatttagcaagtctctcatgagagcactgcagctcagagagaggcgtggctcaatgctccacttgggatgcatggatgcattcctgtgagagtgcctgcattctccgggagcaagcatgatgaagggaaacggcagaggagggagaatgtccaggtaaaggacagacctgtgtaggaaatagggtatggggggaatcagtatgagatgtgtccagagagcaggagagatctcaacttcagtgctcaaacaatctgttgagaaatctgcgggagcctgagaaactaactattgcttttatcagcaggaaaactaaggcagagagaaatggacttcaggccagccctcaactcccttgctaaagctggaaacaggacaggagcctcttgtctctttgagtcctggctggttcccacgtggctgaaccactcctctggccttactgagctgtggctcttatctggtagtggccatgtggaacaagggtgcaagttgctccctgcaggattcaggctaaacaaggcccttacaattgtattgaagaaaagttaacaatagagcatggggctatagaatggaactgtcaagagtgcccaatctaaacagagatgggccctgggtctcgctccctaattcccaggccattatgcctgggagccctttgccctaagaatatgggccactctcaggctgcattaaaaggaaaataatgccgaggaaatgggaggatgcctaacacttggggcactatgttcgttctggggccttcgcttcatgaggacactgatgaccaggggaggagagtgagcgagagggtggagtctgaccagaagtcctgtgacaatggttgaggggactggagaccactgggttggagcagagaagattcaacctgactttggatactcaagggaccttcagtagaaaaagaaatacctggctgcttcactgggtactcaccgtgtgctaaatgttctacactgtgctaagggctttttgtgaattatcccctttcctggcccaacgtcacctgctagtaagagcataagcaaggctccacgctcacatcttcccagaggtcaatggcttaaccgccagcctatggtacttgaacttctttcgtgcggacccagagaactgagttaggacccaagacagaaactacacgttttaaccaatattaaccaataataggaagagatttctaagtcagagctgtctgcaaatggattggatagtcttttaaagtagtgtcccagagggtgttcaaaagaggctgcatgactctggtcaggttaagtacaagtgcaaggttaatggtagaaccaggggtcaaaccgagtttttccaccctgagttcaggcagtcctgatcacaggatggatcctgtgctggtgcgattgccactgtgtactaggtgttttccccttggctcagctgaaacatgtttaagatatttaaaaggagttttactaagttctgtgccccctctattgtgggagtgtcagagcccatctgggcccgttgcagcatgtctggccctgtctgagagggcccgcaggggctgtgttaccaggcggctcccaggcgccttttgggaaaacaaaatgaccaggtgtgttagggccagcaggcttccagggccactactcaaaggcagccaggggactttggctgcccttaaactctctgtgcagtggggggcaagcaggcatccagaccgaatggaacgaggtggggtactcaaggaatatggcatgtctcacccatattccctctcagctcagcctctgggggactggggccaagtctcagggaacagaggagtctgtattaaatggaaggagaacatcgttttgtttttgtttttgtttttgtttttgtttttgagatggagtcttgctctgttgcccaggctggagtgcaatggtgtgatctcggctcactgcatcctccacctcctgagttcaagcgattctcttgcctcggcctcgtgagtagctgggattacaggcgctcaccaccacactgggctaatttttgtatttttaatagagacagcgtttcgccatgttggccagggtggtatggaactcctgacctcaggtgatctgcccaccttggcctcccaaagtgctgggattacaggtgtgagccaccatgcccggccaaaaaaaatcacatttttaaaaacccttctagcagctgcgctatgtgagccaggaatgcagggctttaccccagcctggcgcgggggccccaagctggcagtggagggcaggggaaacacaggggggtgaagagctgcgctcctgagagccagcctaggacaccaaactcatggagaaggggccctgtggagctgaggtgcccgtcctttgagggaggggtctgcaccggaaatgtagggcacaatgggatcacgaggggcaaacaaaacaaccccaaagttgaaggatggaaaagctgacagaatatggatttcctgcttgactaatgtcagcccacaaatagatgtggctgacgtcacttacaggaaccccttccttttccttacctcagcccctccaaggaggtgggtgggggagcgggtgagaatgaagccccatgcccttaggcatccgctgtaggaaaggaagtcacttctctcctacacacccagcatggcactaactgtcactgtgtaccatctttggcagacttgggaaggaattcattccagtgacaaaggtcagatagtcctccccagttaaagaaggaaccctggcatttaactgggtctccctaaggcaaaaatcctggagacaaaagacactggtgacttcccagcagaagagagtgaagggaaacccaggtttggtgtaatgcagcaaataatttggaataatttggggattgacttgactgaaaaaatggaatggtttctcaatgcaatatggatttcactttgcacccacagtcccaaacttagtgcttcagaatgcaaattttatggaaattttccttgctttaccagtttcttttttattttattttctctctctctcccactttctttctcctctctttcttttccttctttctttctttttgagacggagtctcactcttgtctcccaagctggagtgcaatggtgcgatcttggctcactgcaacctccgcctctcaggttcaagcgattctcctgcctcagtctcccgagtagctgggattacaggtgcgcgccaccacgctggctaataatttccctatttcttgattctcctttctaagagatatcagccattacttataatagctaagtcatgtataattatttaatataaaagtacgaaaaaaactagccacgaatgagcagtttaagtgtcaaagggcacaaaaatactgccaatgaggaagaggaaagaacggctgaatacgagatcacagaacgagaaagcggccgcggagtgggactggagactgtgaatcacgcaggtgaaatcagaatgggatcccactcgagacaggagccaggagctagcagcagccctggagccgccggcccagccctgaagccgctccggctgtcgccacagcgagaggaaacctgaacgctctgctcctccacagcgagtccctgcaggtggggacaccgcccacctggccctccctgcgccccctggcggagcgagcctcggcctctcccgggccccggcctctccacgaccgcctggccgcgcgggaaccacccgcggactcgcggcctctccccaccggaccccgcaacaccgcggggacgcccgggaggctactgaagagccagtggcgcctgcctcgatcacacgtcccctgtggagctccacctgcccgcacgccggctcgggcgctcccataagcggccggccgcagaggggctccaagggaggcgcgcgcccgcgaagaagcactccggccccgcaaaggcgccccgcggccctgtccaccaaggccactggccgacgggtcggaagagagcccttcaagacggaacttgcattgcgcttgttagagaaaattatgtgtaaaaactgagccattcagctttactttccaccccgcgttgatgtaaaacatgagttcctatggaagatgaggggcttcgtcaagtgtgtaaaaacaaatgctacctctttccattaaaaatttatatatgtatattcattctcattgttgaaaatacaataaaaagtaataaaaaatcacatgtaacgtcataagaaatcaacttaatgtttacatgtatgaaaatcacatgtacaccttgggaagctgaggcgggcggatcacctgagaccaggagctgcagaccaccagccaggccaacatggcgaaaacccatctctactaaaaatacaaaaattagccgggcatggtggcgcacgcctgtaatcccagctactcaggagggtgaggcatgagaatagtttgaacccaggaggcagaggttgcagtgagccaagattgcgccactgcactacagcccggatgacagagcgagactctatctcataaataaataaatattacatgtaacacaaagaaatcaacttaatgtttctatgtattttccaggtatttctgcacctatctataaatcggtaatatcctacataatgctattttgtacgctcctttttcaaatattacatcatgaatattttcctaccttactgtaattttcaaaagattgatttttaggccgggcgcggtggctcacgcctgtaatcccagcactttgagaggccgaggcaggtggatcacttgaggccaggagttcaagaccagcctggccaatatggagaaactccgtctctactaaaaatacaaaaacttagccaggcgttgtggcaggtgcctgtaatttcagctactcgggaggctgaggcaagataattgcttgaacccgggaggtggtggctgcagtgagccgagatggcgccactgcactccagcccgggcgacagaatgagactccgcatcaaaaacaaacaacgaagtaacaaacaaacaaacaaacaaacaaaaacgaaaacaaacacgttgatttgattttttaaaattcttgctaactacccatcatatggatgtgccatacttgtttagccattgaaatcctagatgtttacttggtttctcattcttttctattataaactgcaccatgcagaagaggtttgatgtaaattgattattctattaaaatagcttcctagaaagagaattcctggatcaaagttacaaactcaaggctcctgtgacaaattgttaaattgttttccagaaagatggtctaatttccttcttgccctcagcgtaagacaaccccatgcccgcccaccgccaacaataagaagattctccagcactgagttatatttatttaaaattttgtcaactccagaggggaaaaagtaattctccttgtagttataatttgcagttctttgattagagggactgaatatgtgttgtgtgttttattttattggctttttgtatttcttcctttgtagttggccttatcttcagcctatttttttcactggggagataagttcttctgattagtttctaagactgctttgtataatagggatatttacctcttgtcatgtttgctgcaaatactttttctagcataacatttgctctttaaataagttcatattttttgagggactgaaatctaaaattgtgtgtatgatgtaatcaaacacaccagttttttccttcatgtttcttctgagattttatgcttaacagttctttctcctctcagggctgattaaatattcactttgttttctggagcttgctcatggtttcttcttttacatctgactttttaatccacctggaatttattttggtggctggtgagagctagggttccaatttgatttttcatccaagcttccaatttctccattaccatttattgaataatctatcgcttcccagttggttttctttctcgtatattgggttctaacatagtagggtttatttcagtgttttccattaggtttcattgatctgtcattattgatttttcagtaatgccagagggacttaattactttcagttttataatacattttaatatctagtagagaaagccccctcaatggtcttctctttcaaaaaaagttaagctattctcacttatttattaaaacatcctaagaatcagtagttattctccattaaaatttctaattttgtgttttcttttttctcaattaaatttatattttagaagttggtatcttttggatttataaattatgtttttctggtttttaaattcattaattcctatctttgcctttgttataaacttaatcttccctcctgaggtttgttttgttcttctaatggattcagttattttctctgttcatttttttctgtttttgttattaaaaatggggtctccctatgttgcccaggctgaggcagtggctatccacaggcacaatcatagtccactactggctcgaactcctaggctcaagtgatcctcccacctcagcctcccaagtagctggggctatcagtgcacaccattgtgcctgaaaaactttaaggatgtttttcatctgagtacacctttggtcacatcctgagtttttacgtacagggtcatcattgttgtaattttctaatagcctttaacggtagttttgaattctctgttgtaattgaggagattgctttaaaagtcccaccaaaaagttgtcctttaattggagttttataggcttgtggtcagagaatacagcccgagcaacttttctgatgttttgaaatgtgtgaccaagaagttgatcaattttttaaagtgttccctggatgcttaaaaagaagatgtttgtttataggctacaaagtgctcaattaatttaaacatttaaaaattcagattatcaatctcattttttgtataaaattcacagttttactgtatatagcacttttatccatattaaatggttcttttggacaatttaatgatttctgttttgaattcattttggtttaaaatgagaatttctattcgtttgccatctgatttgtacttacctaataaatctttgctcttcatttatttttgggtccttctgttctaggtacttcttttgtaaattgcatgcaattaaattttgcttttaaatctcatctaagagacatttacttttaacaaggaggtaaacacaattatgttgattgttataaattttaagtttgtttttctctgatcttctttcatactttgtattgaaattcttccttcctgcttcctttattttttctgtcttagctatgtgggctctgatgtggcatgggaggtatatgttttcagggtagggaaaaggctctcaggctggtgttggagtctcaagtctgctggctctgtggcctgaggcacatcgctcaacctctctgtgtctcaacatcctcatatacagaatgcagatacagtctcatagaactatggtatggattaagtgaaacaatatatggctgatgctactgttattcttgttatactcataaaattttgcctgtggttcctttaggttttaaaaaaaatatttctctgattgctaaaactgagtaatagggctttattttaaaattctcctctacataggacaacgcatctggcatgcttttactaatcccttctagccttctcctctcaaatttttaatctgaggatttgcaaccctctaattattattgaattattgctttaatttcatacatccactctttccagaatctactttttctttgacattagaatttggagttttgcaactacgcgtaagtttagtcttgatttcatgtttgcctgtgtgaaccaatgtctgcctttctttacaacatttcattattaagatcttaattgtgattcagtctttggtcaactggcaaacgagttccccccaaaagtaaactccaagaatgacttttgttgccctttggttgcctcattcaaatgacagggtggatccaaatttaaaatactgtggaactgttctaatgactctgaatttagggttcctgagggagagtcagctctgggatgcctgtgtgcctctaggattgtttcaccttatgattcaataaattttccagaaaaagaatgtattggggtatgtctaggggtggctcctcctgtcccccacattctaactggaaaagaggaatccgtttcgatctgcctactctgatctaccatccccacacacaacatccccttacctaggccaattctgaaaatgtttactgtgcgtatatttctgattatgcttttatccaaatttatcatttcttcctctgaaataactctaattcttagatttcacctggatcctatagcctccagttctgtcctattcatcctttctcttatctcttctgcattctgagagagctttaaattttttaagtttgtctccacattccacatttttaaaaatgtagtgccatcaatgtggattttcattttgctaaaacaattttagttttctggaactctgtgcttatgtgaaccagatacattttcatttcacatctgcccactcttctctatcataaggatcatatatattctggcaccctattagagatgcccaagactcttctttctttttccttttttttttttttttttgagacagggtctcactctgtcacccaggctggagtgcagtggcgcaatctctgctcgctgcactcttgacctcccaggttaggtgatccccccacctcagcctcctgagtctacagatgcaccaccactcccggctaatgttttttttggtttttttttgttttgttttgttttgtttttggcagagatgggtttttgctgtgttggtcaggctggtctccaactcctgacctcaagcgatccacctgctttgacctcccaaagtgttgggattacaggcgtgagccactgtgcctggccacccaagactcttctaatgttgctttttgtttttcataattaaacatttttcaggaatcttcaggattattttcctcttccttaatgctgcaggtttttctcaaaggcctccagcaggatccctgtcgcctccccaccttccccctccccagccatctatctctccgcctggcaccagaaggggatcgctacaggctgctccttccctacaggaggctaacttctcacttctccagctagagggcagggttcctgggtctagcaggcttcatcccatgtggtaggctactttcctatcctctctaactagtcctctgatatcataaaccagtggtttgcaaacttttaaaatcatgggctcctaccaattaaaaattttttgagcatgccctcctccattatacatatatttattataaattacagacatgtattgctctctatccatttattaaatactagccaggctttatatatatatatatatatatatatatgtagaagttctgatcatttctcccaatagtcccatggatcactgtgcgtgtgccccacattggaggttataactcaaaccaaagcagtccatgaggaaccacagtgcctggccccactgttcccaggctctgctcagttctgctcagcctacagggtttagcttgcaggcttccatcaaccccatgtagggtgcttcatccctgtaatgaccactttcctactgttttgttttggggtttgtttttttttttttgagatggagtctggctctgtcacccaggctggagtgcagtggcgtgatctcggctcactgcaagctccgcctcctgggttcacgccattctcctgtcccagcctcccgagtagctgggactacaggtgtgtgccaccatgcccggctaatttttttgtatttttagtagagacgggggtttcaccgtgttagccaggatggtctcgatctcctgacctcgtgatctgcccgcctcggcctcccaaagtgctgggattacaggcgtgagccaccgagcctggccattcctactgttttcttggagtggaagtaccccttcttggagggggtaggaggttgtgggaaggagatgggaggaggagggagctgtggtcttgcttcctgctgctggcaagtgcaggcctgggtgtctgaggcaggggcagaagagagtacagcaaggaagcctctttttatctccttacaatgggagtggtggctctcttaatgagagaaagaatgggccacaaattgtttttctcctgctttaggagccagatctccagaataaaatttctcattaaaatatcagtatgccaaaagttaaccagcaaaataaaaaacctgttgacagactggaaggcctgggacactgagacagcctgttgcagaatttggagcctcaggagggaccaaagtgaagggtccaaagggtccgaagggaatccactcaagaggacagtaaggtcatttataaagcatggctgtgacagcaaggctcaccccacttcatcaatgttatgggaggccttgttgctcctcccaaggagataaacatacaaaggtgagctggcaggccactgcactgctcaaggcacgctaggaaggctggctctccaacctgctgccgcagtgaggacccggggcctcagatggtctctccaccagtaaagctgcttggcacttgacagtgtaaaatcaggaggttcctccctgagggaggtgggcaggcagccaggagaatcccagagaatgcagagtgccacaactgtcaggcctcggaacccatgatgtaatgcctctctgggggccaaggaaaacaagcccactgttgtcactgccctcccagcaaccaggcgctgccctccccatggcacggctgttctgcgtaattatgatcccactttctctccttgggaggaggaaatatgaaaaacctttgttgtcacataaaaaccaacccaagatatgagaactgtcttttaaaatacatcttgctgtagagagatttccatagcaacttcagaagtgtgtgtatacaactagagataagtccaggctgatgaaagctacctggaatgtgaacaggctctgggcatcagcagctgtggatttttctagaacctgtcatgctgctgtgtgaccctgggcaagtcacttaccctctctgatgcctaaggtgatagaatcatcattagatcaggctgagagagatcaaggcatcctgtccacactaccctggtctgacgcttcagttccccaaagcttcccctgcttccagcttctgtccagtctctggctgaataagtcctggctgaaggcctctgccaatcttacttattatttgacattgggaaacagaatgatcatttaagcttgattctaaaaatagtgcttagtcttggtaagagaagtgctttgcctgtttaggaaacaatatattaacggggcagattcctgggaaacagtctgtgagatgctgagatttgggggtgggagttttactggggctgctctcaggatcaatacctctggggtatagaggaagttcccggatgcagtggtaacagaggccttaggcgatccctcagggaccctggagcctggctgagtgtcctactagaagcaaacggggttaggcctttgaactcccacactgacaaatcccctcgggagcttgctgcccccaggcaaggggtttgacctgaagagagggactcagtcacaaccccagctaagggaaggagagcccgggtcctggagggggcatctgtccccttcatgttgacatgaagcaacatgtcatccactacatggatgtgtttgaattggacatgaaggcagcccaggaggctagtatgataacatggtcaagaccataggcagcagaggcagagaaaacagcaagactgggattcacatgttagtctcagtggccttaagactctgagattgggaaagttgccagtagagtagaggccaagatttcctcgtatgtgcaggattcagcctgggttggtgacacacacatggaagttcagagtcagaaaccagttcagattttggctccacgcttattattaatagctctgtgacctcgggccagttactttctatcagtttcctcaactctcccatgagccttcatgtccaattcaaacacatccatgtagtggatgacatgttgcttcacccaaatgcccctccaggacccgggctctccttccctcaggcaaggtacctctctcatagatctattgtgagggcaagctgggatgacatatggattttacacagaactagcacaggggtgcaacaataacatccaccatgctttaatacacctcatgttatacctaagtctttggtcaaatggccttttcgcaagagaagggaactttcagagaatttccgatttgctcattgttcctctgtgccttggtcttagcgggggcttgtgacccatgtctgcagagagagagagagagacccagtggcccaccagggaccaaactaacccagcctcagcttggaagctatggaaggccatgcaatatcaaataaggtgcatcatctaagtactttgcaaactacattctttaaaacaagcttattttccagtgaaaaatagtcaccccttcttgtgataggttcaataaactacgaaactcacttgcaggtactttgttgcatgttcagccatctgaaatacatgccagagagcatctgaggaagtgaaagacttcaaatagcttaaagggctacgcaaattcaattactatgttaatagacaacatggcttccatcatttagaaaggaaaacaggaagagtataggcccatgtatggtacaagttgggctgttctaattaaaagaaggcagcacaaaattcccaagagttatcaagggatctgcactattattattaactttcaccatcattggattgcagtacatagtgcatatatacaccttgtttgactctaacaataaatcctgtgtccagctttcagataagaaaattgaggtccagagaggtgaagcgaccagcacaatgttgctcagctaacagtaccatgaagagtttggggtcggaacccaagcacatgctttctccattgggggaagagtgtctgcttaccagagaaggctcatgaagccctgtgcagtgtggtcccactcagagcagatgttgcaatgtcagctgctgagtaatggcgaggttctgaataggtgagcatggtgtgtccctggggctctgtgtgtgagaaaggtcttccaacactgcactggctctcagaacctgaacctgcatcctggagcctgaacccttgttctgcggcagcagaatgccctctcagtttgaccgtgtgtctgttggccaaaacgctgaaagaaatgtctgcaaacagaatgtctcaaaaataggtaggagatacgattcaaggcacccatgtagggtgtgttgaggctaactcctctccagacttctttgtcttgtttgatctctgctaggacactggtgcatggaagatttggcaatataatcgtaagtgttgacaaattaagggcgactaccaggatttgtgtaaattacacaggatgcttcaccatacctcccaacataataaaaataatctatctcaagcaaacatagcttcattctatctcaagtgatcctcattttaaaatgaggaaactgtagcccagagaggttaagtaacttgccctaggtctcacagctacttaggagcagaatcacggtttctaacctagatttagactccacatgtcaaatagattaaaatgaatatccagggctgggtgcagtggctcacgcctgtaatcccagaattttgggaggccaaggtaggaggatcacttgaagccaggagttcaagaccagcctggccaacatggtgaaaccccatctctactaaaaacacaaaaattagcctggtatggtggcgcatgcctgtaatctcagctacatgggaggctgaggcaggagaattgcttgaacacaggaggcagaggttgcagtgagcagagactatgccactgcactccagcctgggcgagagagcgagactccatctcagataaataaataaataaataaataaataaataaataaataaataaataaataaaatgaaaatccaggaccccttgcaaggagaagagtcattaaaggcagctcgagggtggtggaaggaggtggcttcagtcctgcccttgagccttgttgatggctgttccaaggagttggcattttgttctacagccctggatctctgtcaggccacatctcccttctttcccatgagtagcttctctgaatgactcccaaccaccagcctcctaaaacaatgtttcccaaagtatgttccatcagtacagtgcttctcaaactaaggtgcatatgaatcaccaggtgaccttgttaaatgcaaattctgattcattcattctgggctaaggcctgagattctgggaactctaacaagttcccagtgatgccagtgctgctggtctgtgaaccaaactttgagtagcaaggtaccaatagtgctttataataaaaaggatttgcaggcaaatacaattaagaaaggctgaaccaaacaaaaataaatggtttcattacttcaggacttctcagagcctttaaaatgctaataagcattattaatacccaagaggagtaagttgcaatgtgttatatgtgagttactgatgtaaccagaatgctttgatatattggtttgcaaagaaggaacagaaaatcaggaaaattctgtgcctttttcccaccttactttggttccaatgctgcaattctagctcatactgaaccccaactcagcactcccctctttcccattgtctcctttcaggtgtctgggtacatgcctgtctcctccatcagaccacatacttcctggcacccctactcctcctcccttccctgtcccagcacaggctctgtactcagaaagccccatgtggaatacctttcacagacacggacggtccaggcagcaatgatccacagagagatgctgaacacgagcagcacagtgccagggcagatggtcatgagcgtcttcatgacaaagcgggtgttgaagttgatcttgttgagggccccgatgctgcgggacgaggcatcggtgaagagcttgctgtgcagcagcatgactcgggcgatcaggtacaggcgcaggaacatggggatagacaggatgatgtccacatcggcctccgcccgggagggtgtgtaggagaaggccaggcgtgccgtccagaagaacttgtactcgccaggaatggggtggatggcgcacaccagcatctccaggctgatgtacaggatgcgctcgtaggtcatggctatccgccagtcatccgcgccattgtcgatcacgaagagctggtgggagcagaaagtccattagtgtggccaggaccaggaagcccacagcagggtccaggcaggacaggtggggcaggctggggcaggctgctgggctcaggtcagcctgaccacctcagcatgctctttaggggccttgctatgtggcaagagccctgtatgtggagtagggagagctggattcagtctacctgggaagccctggctaagacactttgactctcttggcctcactttcctcctctgcaaatcgctgcctgagatatagtgatttataataagaaataatgtacttggtctttatcctggtttaggcacagttcccaaaacgctcggaatttccaaagtgataagtgtcatttgtatgctaatgagatgactagtggctggggtcggtcggggtggggatccagggtggcctcaggatggcgctggttgccaggggaaccaatctggtgatgagagggttggaactttcagccccaccccaccacctcctgagaaggaagaggggcccgaaggttgagttgatcaccaatggccaatgatgtcatcaattatgtcggtgtaatgaaacctccacaaaatcccaaaaagacagtgttttgttttgtttttttaacttttattttaggttcaggggtacatgtgcaagtttgctatataggtaaactcgtgttacagagatttgttgtgcagatgatttcgtcacccaggtactattgggtacagtacccaatagttattttttctgatcctctccctcccactctccaccctcagtgtctgtcgttcccctctttgtgtttcgatgagcttccagatagctgcacacatggaggtccctggacacgtggagtgttgcgtgcccagagagggcatggaagctccaccccttcccatgcgccctgccctttgcttcgctcccatatggctgctcatctgaatcctttgtaaggtcctttataataaaccagtaaatgtgtttccctgagttctgtgagctgctctagaaaattaatgaaaacctgagaagggcgtcctgggaatccctgatttatagccacttggtcagaggctcagataaaacaacctggggctggtgactagcatcggaagtcaggtaaatgtggtgggactgagccctcaacctgtgggagccaacactaactccaggcggacaatcaggcttgagttatattgcaggacactcagccagtgtccattggagaattgcttggtgtgtgggaaccaccccctcctttttgctgaccacaagtgttctatgttgagccacttcccaaggtcccttccagcacacaggtgccaaattggctgtttcacgatggtgagaaagatcaactcatttatattagaaacacatccctgagcccctgccagacctgagctgagccctgtaaggggatgtaaagatgaaaaagtcatgtttcctgcatgagtgaactcacaagggctggcacagattccttctccccactcagagaagggggcagcaagtgtttgctggcagcactgtgctctcagacagtgcagtgaagtgttcacggcacggactctggagccagattgcctgatcctaacactactggctccatgatcctgggcaaattaccgaaccaccctgtgcctcagttacctcatctggggatgatgataataactgctgcatagaggtcactgtgaggctgcagtgggttcgtatatgcaacatgcatggaatcctgcctagcacccagcacactatgtaactattagctattcttatttgtagcattattaatggatctggtctcggtctttctgtaaaatgacagttgggctcagtgatgtctaaacttccttctggccctaaactttcacgaagatgcttcctgctgtcacctcatgaggatggctgttctcacaagaattgactgagcacctgctgtgtgtccagcctttgtcttccggtaagtcccactgtggagtcccaccatatttgatgactgtgaaagggacttcacatccttcccctctggggcctcagtcttcatctgagactgaaatgagaagcctctaaagtctcatccagctccgatgatttgattcttggagggtgaggcctgagatccgggcatatgttcggtgtgggcctcctgtgcaggcacctcacttctgggaggtagtggaatgtttatcatcacactatgccctctctttactgggtccttggccctccagcagatctggctgttgcctgtcccagctcatccacgaacacatcccactcaagactccagcctcacatgctgcctgctccaccaacagccacagagagctgctgctctccaaagctggttatgattgcctttaaggaggagctagcagggtcctgtggcctaacatgagctcaggatgaagggtaccagcatcagcacctcctggctgggagagcaggccatgcatgcatcctgggaaggcctgagctgcaaggccggaagaaactaggctgggttaggagaaattaatgttggggccagggttgggtggaggttttatttaacctggaaatacaccctcagcacagaaagcgtaacagagagactggatcagcgtggatttgcgggggctggctgaaagccgagtgaagccttcctttcctcccttgcacagggagatcagggaatgaggagccctttattctgtccacccaactgtctccttgatggtctgggccaaaggaagcttctgctctgcttcaaagttagtcaccaagcagctttctcactccactttgctgccttccttacagttcagcaagaactgaggacccaggagaggacctatggtaccaggcctggtgtggtgtgggcgggcgatgcttgccttgcttttagcatctacctgtgatatgtttctgcagcaaggggaacattccaggcaattcatgggccctgagaggcacagacaggggaggcagcactaggaggcaagtctcttaccttgccgagcctcagtttctctttctccctgctccgtacccttacagagccatactggagagcagaggagacaatggattgaaagggtttaataaactacaaaggatcatttgttcattcattcattcattcaacaaaaatgtgttgatggccctctgagcagccagccccccacccacccacccatgaggatcctgaagggaaactacagggcactatgggagcaactggctgagaggctcacctggtggctctaatcagggagctgtcatctctgaacaggagacagtacccagcacagcaccagctggagactcaccctcctccttccccagtgcagctgagcctgggtttttccagacataggttttccccagcaattagaaagccctaatggctgctcaaagggttccctctgcttctaactgccgcccgacaggccaagccatggcaacgtgactgcctggccaaactcttcaaatacaaaattaaaaccatctactccgtaataaagaatcgcatctggttactatagtaactgggttcactctgggcaggaatggaagcaacgagtaacagattcctttgattgcctgatgaggagtgggattgtaagtaagagctgaaggggagaatgcaccggcagctctgcccagcgagacgggagggtgctggtccccagctgcctctcaggtgccccgccttggttgtggcttgctggtgcagggaaggtgggggccacatggggtagtggagctggaggtgggagagctagcctgaagtcccccacatccaggtattagccatgtgatctcaggccgtgcgtgacttctccgagcttgtttccacatctccaacaggggaacactgactgaccttggccctgcctgcctcctggggttagtgttaggatccaataatacagataaaaagttggacagtgctttactcactgctctaaaaatgtgagggattattaagctggctggcctgggggcactcgtaaacagtgtgtgtaaagagcgggtgttttgagtagggggtgggggagagttttcaggctgcaggttaaaagcttctgctagacagggctccgctgcaaggttttctgcatctgcagggtgggatgtgtcccagaagatcccattgctgtcccacgtgaggacactctatgcttccttccttctgacccttggaatcacagctctccaagtgtggcctcgctccctcccgattcagagcaagtagcagataccccaaccctgctgtttcctcactctgggtcccattcattcctaacaaagcacaatcccaattattgatttgcatgtgtgaggttttgctgtctctccccttagacatggttctcaacctacttgcgtcgcacattagaatgacttggagggcttgttcaaaaatacccatgcccaggcccaggcccaccccaggccaagtaatcagaatctctgggggtggagccctggcacgggtgttcttcttaaggctcccaggtgagtctaaaatgtaaccagggttgggaccccccaaccagtcacagttggagctccaaagagacaagcgctgtgtcttccttgttccctgtggcatctccagagcctagcccagatcttagcacttagtaggtgttcaataaatgcttatttagtgaattagtaactcccacttactgcgtgcccctggactaatcttccctctcttgggctcagcgtcctcctctgaggaatgagggaatagactagacaatccccaaggtacctcctgctctaagaagccataattctgtggttctacacagaccctcttgctcgcacctcctgcctcatctgtgttctcggtgcacctgagctctccagggacaggaaccgtgcctggctcatctcaccccactcccatgcctgagacgttgcctggcacagagtgggcagtcagtagaatcttggtgaataaaggggtgtgtaggcggatgactgtgtcatatgaagaaaaggacagattgcctgtggcccttgttaaccacccagaatggaaattcctgttgaaaatccattcctaagcctgtgactcacaaaggacctgacaattcatctcacaccatgggaagggacaccctcttattcccaaagggtggttcaacctggaataaactgtcccaggtgacctccaagccttagaaagttctagagcaagtctggaaccaggatcttgagtagcactggaccagaggggctcggggagtgtgtatgtggctccacaaaggactatcctcccctagggcttagtctcagtcatccagccctgattctagaccagcttgactgttggcctctgatggattctggagaagtactgaggtgatgtggacagagtgtggcatggggcagggagtaccgtgggccctcaagtggtctgttctggcctgttccagagcaggagaagccacagaggcccagggctgacaaacgagtctcttcctgatgaggcataggtttgctccttgtactctggcttccctgaatgggaaaaggaaagccacattcttcgagtcactgactctttctgcctcctaagcctaaaaaagtgatttcactcattgagggtatgactgacctgaagatgcaatgtgtcagtaccacagtctctggtttcctgaaaattccattctttcctcagatagttgctctgtccagaggtggctctaggcctaatccctctaccacttaactggtggttctgagaacttgccggattttcagccgttagtataattctgagagctctgggagggagattttatgcaacagtgattccaaactttcctttaaggagcttgtaattagagaaaaaggagaactaacccaactcagttcaatataataattattaagaatcaacaaggttaggccattgtgggtatataaatctgaatcaaacacatgtcccatgaatcagtgcacaatctcaagtagttctagcaaaagacatgcatgattaggatgcaatttgaaaagcttcttgggttacatagggcttcagcagcgcccggaaggcatgcatcagacacaccagagggggcagcttgcagaaaaggccacagattcctcccatcccattcacttacttctgtacatgtgactttgcctctcttccaatcaagaagtacagcctatttctctctccctctctctctgtctctttttttttttttttttttttttttgagacagagtttcactcctgtcacccaggctggagtgcaatggcaccatctgcctcccgggttcaagcgattctcctgcctcagcctcctgagtaactgggataacaggcacccacaaccacacttggctaatttttgtatttttagtagagatggggtttcaccatgttggccaggctggtctcgaactcctgacctccagtgatccacccaccttggcctcccaaagtgctgggattacacgtatgagccaccacgcctggccagtacagcctatttctcaatcccttccgtctgaacttagccatgtaccttgctttggccagtggaacattaaaaagtgtgatacagcagaggtttaaaaaatgtcatcgccatgaggctcactatagacacatggcctcactatccctttcaccccagcctgcagccagtaccagctgccagccatcagaagccgtcctagaccagctgcatgacagaagctcacccaaggtgagaccagcagaagaaccaccaagctgagcccagcccaaatgactgacccacagaaacgtgacctaaattattattttaagccattatgttttgaggtgctttgttatgcaacaaaactaatatataacaaaactaattcttatatttggcacatattagaaaagccaggtcatgtgcctactgtgcccaacattttccttttagattcttatgccacagcccctagcaggaaccctcacccgtccccaccttcccactccactcagttatatttgctggccagtccttctcaagtaactgggtgactggatggggaggagatcagggtcaagggccattccttgatggccattcccccatccccactctccccatggacacatgatttgagatatcaaagaataactcagagcatttaaaaagttattttgcaagcagtttagttgttttgcatacaaagtgttttctcagatgtgaggaagtcagctggtagactgaatcagggaacaagggcacaacagaattaatgggcaggggggccgctggagaaaaacagcagggagtctgggagcagtggaccttgttggcaaatgctgagggtaaatggattcgctggcagctaacaaagaggtcagcatggcattccatccttggacggccagcgagggatagtacagaaagcactttcagttattcagggattcttcagaagcccttggctttcagctgtgggtgtgtcacaggccctctcccttgtcacctgcacctcagggagtccaggtctgacctttccctggttagagtgtctcgccaagcaaagatgtcatcaccagctcaccacaaggccaacgctgaaggccatctggacacctcaggacagggccgttcagctgcaatctctgcagggcctgggacaggctgccttgacaaggagacaaggacactacccagtgcctccagcagccacatggcacagcccgagcttcagacttgcgaggcctccccacatttcctgcaaaggggtaggcatgcagggaagcttgccttttttctttttttctttttttttttttttttttttttttaggataagtttagagtcgattcattggattcactcgtttttccccccattctattttgaaagacttgagacctttctgattttttatttaagcaaaatctgtcattaaaatgttctcagctatcagggaggagagcgtattcctgcttagacactttctgaccaacctgaaaaactttcactcttgcacaactgtgaatttctctaaattaaaggagagaaaatggaaaaagcctttttgtgtactgttctctctctgtggggagaagaacttccgggaaaatttccatcatttaaaaaaacgacacagaaacaaagcaagaagaaaaaattacagattttcttaagatatattatttatatatatgttttatattttatatatatatatatacatatataaatttaaacaccctggagcatatattctgcatgtacaccattactacgggggttaccatggaagcaacatcaaaaatcctgtagtacctaattaggtttccctgaggacaggagctgattgccagtgacgaaatgaacttctgggtttgcagcaatggttggtaaaattaccagtcagcaaatgctccatggaactagaggaagaaagggaggcgggtgggggttgggaagcaaaggtggaaaaatggtggctctaaaagaggccagccagtgaacaggccttgtcagggaagtctatgattctaccataaacaagatgcttagggcgttggggtccacgctaccccgctctgtgtctaagaagaaattgtcctcatctgaaaccatcccactccctgggccatgtgtgatgtcccacagtggctctttggtccggccaggataggcttctcctgagcgcttcgccagagctcacttttggtctcttgcagtgtgtaatgaccactcatgggggttatggagtctgaagtttgtttgggactaacagagaccagtggtgatcataaatcctttcccctgtcctcagttctcagagaaagaaagccaagtttcggcatttgagcgagccactattttttactcacgtagcaggaatttcttgatccctgagcacgtcaccactagggatagagcatcccacctctggccatctgtgtgtggcaagtctctggacctcagattcctcagtgtaatgtgaagacttggatgcaatttgtggttttccattttctctgggctgtggggccatttctttcataagatttttcatgtacgcccaacatgggaaacagacaaattcagagctgttgtagttgaaagggtagagaagaacattcaaagatcaactcactcacctcctcctccagcctaggtctctgtagtggaccccatgctctccatagaaccctttgactggaaatcctttggatggaccagctggtctctagttgtaaggagagacaaggtgtgatgctggaaatcaagtgtttggggtctggttcaagaggtgctcgatgcacaggcagggagctttgccccgatcagcttattcactcattcattcattgagcatgagttgagcccccattatgtgacagtccttggtaagctctagggatatagcaagacaagtagacaaggcccctgtccccacagagcttacatttcaggggaggaaaacagatattaaacaggtaaaccatttaattttagagagtgatgcctgccaggaagagaataagacagggcaaaggaaatgagagaagtcccagacagccaggacagggagggctctctatggaagggacctctgaatccaaagtgagccttgcaaaggtatgcattacagaggggacagcatgtgcaaaaaccccaaggcaggatggagcttagagagttggagagataaaagaaagaagaccaatgtgagaaagaagtgagggatgataccaggtgagaccaagaaggtagcaggacccagatcattgggaccttggatgtcacagaaggagcttcctcaaaggacaggagaccacagacccactcccaccagggccatgtgcaccatgtcaccactttctgaaaacacactgcccacaggttaaatatgcaccacagctcgggcctccgaaacaaaatatcatagactgggtaactcaaaaaacagaaatgtattttttcacagttctggaggctggaagtctgagatcagggtgccaacacggtcaggctctcttcccggcttgcaggtggctgccatctcactgtgtcctcacatggcagagaaagggagagggatctctctttttctcttctcctagagctgcagtcctataggactagacctcatccttatgaccttatttaaacttaattacctcccacagaccctttctccaaggcagttacattggaggttagggcctcaacaaatgcgttttggggagacacaattcagttcatagctattcccttttgtgtcaaaattacccaaaagccagactgtgggccgagccaggtgattctgcacataccatttcattgccatctcataatgtccctgtaagggagtcatacatccatttagcagatgaagaaacccaaaccaagacaggttcaatcaattgcctggggcttgcagcattctgtgtcttccaagtcccacgccctttcacctgccagcctgctaagcaggcactctatttgggggctggccagtttgggctttactttgtcttctaaagaaaactcggctgggcgcggaggctcacgcctgtaatcccagcgctttggcaggccgaggcgggcggatcatgaggtcaggagattgagaacatcctggctaacacggtgaaaccccatctctactaaaaatacaaaaaaactagccgggcgtggtggtgggcgcctgtagtcccagctactcgggaggctgaggcaggagaatggcctgaacccgggaggcagagcttgcagtgagtcgagatcgcaccactgtactccagcctgggtgacagaacgagactccatctcaaaaaaaaaaaaagaaaaaagaaaagaaagaaaactcaagcccaccctttaaatgctcattctcagaagaatctttgctgaccagagaatcaatatatgattaaaataaactgggttctatccctggtgtccacaccacctgggaaacccacatcgttatctgtaatctagactgggctatgtttgtggaactaagaccacggctttcatttccacagatacaatatccatttatcatctttcccttcctcctcttcccgccagtgaacaggcctctatggagacctggtgatggggtccctagcgaggaagagaccatcttagtttaggagcccacttatgcaccccagcatgtttgctaatgaagaagattcctctggacaggcttggggtggggtcagaggagaccaacacagggcttaatatatgtgccctagaaatgaacaggaacactggagatgggggattgtgagctgtgggactggaaggagaggggagctggctaagcagcaccttgggccagtcccatgagagggggaggccggagcccactgaggacttgaccacccatgagacagggacagtgctgagactgtaagatcaggagcatgtggcgttcagcgctgtcttatctgttgtgccaccaccacctcaccccttccccttgctccagatccatggaaatgtcagctaacctagaggccttggtcatgggtccctcgaggagcaacaggaacaggaagggtgcctaaagcggttactaagtacaggatggaggtggagaattcagcagaaagagtttggcatcagatgagctgtcaagagagaaatggaagtttccaagcccccagagaccagtggaaagacaccgggtcccctcctgtgtggggtgggagtttgtaaccaattatatttgaagcagtaaggccaagtgaccccggccaatccttgggttgctgtggccacaccttggtctcatcatgtgctccaccccagccatctttacattgctgccagagcaaatgttctaaaatacaaaccaaatcatgtcacctccccttctagaacctttccgtggcaacccagagtgtccaccctcctagctgcacttggccaaaagggccttttcccacctggcaccagctggcccctctatccccatcacctgccacacccggtgtctcatcccagctaaaccaagttaccagtaacccctaagcttgcgcccttccatcttctgtacaagcactccctcttctcagcttcttcaccagagacctccagatccagcgtcccacccttccacaggcctaagctggtcccttctgactcccaggtggggctgggtgccttcctccagtattccccaggccctgtgccccctgcttgtcacagagccaatccccaaatggcagctggagaaggatggccagacagttggggagtgctagcccccgtttcagggggcggagggagcagggcggcggtctccattaacaatggtaacagcaggggccatgtattgcagcctcactgtgcaccaggtcctgtgctgtgtgccttacaggcaccatctcatttagtccttaacaggattttgagacaggtattcttatttctattttacagacagggaaactgaggctcggagaggctaaataatttactacaggtcatacagttaataaggggcagacctaggctctacagccagggcaggcagctctcttgactactgtgtgtgctgcccccaggctgtgctaggaaggcttgttgggctgagccccagtgtttgcctatcccaggccaggccaataggtgtttctggttctttgtgtgccttggcagatccaggagtcaaaggtttctgtgcatctgctaagtctggggtaagaggtatcgttttctcaacaggaagtttctgataagtttctttccttttgacacatgaaaggatcctgctgaatgtttgggggtaggggaggaacagcatcatcactggggctgctgggccctgattggttctaagtcacctgtttaccactaagggagaaattctttaaccctggcttaggggatatttttagcaactaaaaataaataggtttttggatctttgaacagcctagggagctgaagaactgaggtcaggaccaggtggtggtggtgggcagggagtgtttgttttttccccaactgactaaaaggcccttcacctccttcccaagggccagctgcactgtcaccccttcagggggagcttttcctgatctcccagtggcgggggcagcacttcaaacagcaacaagccatttggtgagtccaacttgttggctggggcctaagcacttttctttttctttttttttttttttttttttttttttgagacaagagtctcactctgtcttccaggctagagtacagtggcacgattatggctcactacaacctctgcctcctgggttcaagcaattatcctgcctcagcctcccgagtagctgggattagtacccagctaccacgagtagctgtgcaccaccacacccggctaatttttgtatttttagtagaggtggggttttgcgatgttggccaggctggtctcaaactcctagcctcatatgatcagccatcctcggccttccaaagtgctgggattacaggcatgagccaccacacctggcctcctaagcacttttctttacatcaactctttgagtctcacaatagccccataagaaaagtgaacatcccccagacctcatagcaactaagtggtggagacaggatttaaaccaagaggccacactctcatctattaagtttccattctggccgaaacctccttcttgatcgtccatctgagccgcattcctgtccacctgcttgtcagcaccctcactaaagcaggggtccttgaggacagacatctccttggtcactgtcctccacagtgccaggcacagcgcccagggccacccaaatgaatacataaagggtttaaggtgtcaaaactatatcaatgtgactgtaaagaaatattttaattgttcaccatttttataatcctcctaaggcaaaagagtcttttgtaacatatgcacaagatagaaaaagaaatcaaagaatattttaaaagaactgcttattataattttttaaaaaaccctggaaacaacctgaatacacatcaatagggaaacagctgaatatattatggtactcatactggggaacattatgtagctgtttttaaaaatgaagtggatctatatgtattgacttagaaaatgttcatgatatattgctaagtaaaaagagaaacttacagcataatgggtatagtgtgattcctcttttttaaaaaagcaaacaccaacacataaaaacaaaaatgcccatatatgtgtatgcatgttggtacatttttgtataagcacacacaaaaggtgcattaatcacctctggctaaacactaaattgttaacactggtactactggggacgcagggagatgggaatcagggaacctattgatttttttccttttgataatgagaacacacctctgtgttaaaagaagcctatattgcttttgtaatttaaaaaaacccaataaagtattttttaaaagagctgtcatggagaaagccacttgtggcgcctaatggtgatgttttaagcatggccattcttggaggaaaaataattgcccaggtcctttcctgccctgtaattttctgtgtagagcttcaaatcccctgggagcccccaggattttatgaatacagccctgctagaagtgttcatagctgagctcctctcacaagtctccccctccaaggccagcctcattaccagatccacagcccctctaactaagccaccttgtgaaaaatacttccagggcatgaagattaaacaaggcacttatttcaaggccacctctccatgtgaattcctatcgtaggcactgaaagccgcgttagtcagtggcccactccgctcccccactgagggcagaggcctaggctccctgtgggaagtggtggccctccccacggttgagaaaggaaacctgctccaccattccctccatttgggagggagggaccagggccagggccagggccagggccagggcatgcggcagccaccatcaccacagcgactgctgctggtgagaggtcactgcggatctggcctcagcgtgccaggtacaatgccaagacccgtggggtacagcggagatcaggatgcaagttcctgatgaaccaggagcttagaactgcgtgtctgctagagatgcgcagaagcaaacaaagatatggctatggagagggccagtttggtgactgggggcactatttgcaattcggggtctgtgctgctgtgtgttcaatgcccacaggtactgccctggatccagacacctggagctctggctctgggtcccccacactagagggccctgcttgacccctccttaagtcacaccacaccccgtggagtcagaagcccacagggccaagaggccttgtctgcctccaccttctaaacccccgtttggatatccagacgcccagagtcccctgtccaaaaaggccccaggcctgcttccagggcccacgctgccactttctctgtcctcccataggctgacgctggctgctggtaggtacatccctaagcctgagaagcagccaaggggtagctggaggagggggcaggatgaagtttagatctgagggctgtggcatccacagtgccctcagggtcttagattgggtcaggagggaggcaagagaggggcatgctagggtctggggcctcagggtctaggcgcctccactggaggctggcccaggccctgaaggaaacagggatggatgggcctgtcggtcaccctttctgactgtctgggatatgaatgacaggagcagcagcagctgcattttctagttagttctgaggtcaggcaaacaggcccctgacactgcctctcagatgggttgtcccaccttcacacacctctgtagcaggcacaggtatacaggcttgctctgaggcgccttctgccgagtgctggccatgttggaagcaccatacaaagtggttgagtggccaaatgtttgaaaaatgcttctcagagattcatcaggctcattagcatattaaagcttctgagacttctaaagaaaagaaaacaagtcggctttgaaatgcagtttctcaaacttatttgaccttgactcttgttttgaagtaacagctattaatatttcaaggaacactgggaaatgcagggtgtgaggcattcagtgtaacagacaatggagggttcattccttcaagcatccatggttcattttcatgaagattaccatagtcttcctgagaggcaccaaatactcccctgccttcctgaactgactccacggagcacagcccacgccgccaaacccgtcagcatccactcgcatcaccccacagcctcctgtgagccagccaccttcacgtgctttttagttattttatttaacaaatacttaacacagcgtttactaggttccgggtgctagtctcaatgacttacacatactagcttctttactcctcatagcagcccttttgtggtgggccttattattgaaagatgaggaaactgaggcatgaagagattaagtgacatgcccaaggtcacacagctggtaagtggtttactcagacccaggcagtctggccccagagtccacgtacactcatttcttattgctgctgtaacacattacttaaaacaacacagatttattatattacagctccggaggccagatgtgtggaatcagtttcactagactaacgtggaggttgtccgcagggctggctccttcccgaagatcaggcgggggaatccgtttccttgcttttccagcttccagagagggcctgccttccctgcctcgtagcctcttctcccaccactccagcctcctgcttcaccatcactcgtcctgcttcctcttcggtagcttcctctgcctcccttttcacaaagacacttgtgattacgtttagatcccacctggataacccaggatactctcctccatctcaagatccttcatttaaccacatcctgcaaagtcccttttgccaggatatccagggattaggagctggatattttggcagggtggtggtcggtggggcaggggggggcattatgattcagcctaccacattatgcttttgaccattgtgctaaatctagtttaatcttcctaacaatcctaggaagacgttgtcattatttctattttacagatttgaagactagggctccaagacgtcagctgaactgccaagtgtcacccaggtagtaaatggcacagctgggacaggaaccaagaagtgaatgacttgctccttcacacctgccctgccatcggagaggcggcactcaggacaggcagggccttgggggattccgaaggaggtgctgcttttgttactctctagactgagccctcctgacatcctaagcccactgaaaacctgatgcgagctatgaatttgctttccctagaacaagaagcatttacagaaacacaccatgtattgcagctagtttctgggagttcacgggccccaggttaggaatgcttgctttttttgtttgtttgtttgtttgtttgtttgttttgagagacagagtctcgctctgtcgcccaggctggaggagtgcagtggtgcgatcttggctcactgcaacctctgcctcctgggttcaagcaattctcctgcctcagcttcccaagtggctgggactacaggcatgcactacaatgcccagctaattttttgcattttttagtagagaaatgaggattcgctacatatatggcaacatatatgttggccaggctggtctcgaactcctgatctcaggtgatctgcccgcctcggcctcccaaagtgctgggattacaggcgtgagccaccatgcccagccaagaacacttgcttttaaaagcagagtatcaaagggatgtttgcacacccatgttcattgcagcattacagatactccttaacttatgatgggtcacgtcctgatgagcccgttgtaaattgaaaatattgtaagtagaaaatgcatttaatacacctaacctaccgaatgtcacagcttaacctagcctgccttgtgtgctcagaacacttacattagcctacatttgagcaaaatcatctatcacaaagcctattttataataaagcattgaatatctcatgtgatttactgaacactgtaaacggtagagtactgtatcagttgctgaccctcgtgatcacagggctgaccggggctctctgccgctgcccaacatcacaagagaatatcatgccgcataccactagcccaggaaaagatcaaaattcaaaattcaaagtacagttcctgctgaatgtgtgttgctttcacaccatcataaagtcgacaaatcttaagtcaaatcatcgttaaatctgggactatctctctctgtaggattcggtactatctgcagttttagacatccaccagggatcttggaacacatcccccatgtatatactgtacagaatttcaggtttgcaggagacaagagttctggagattgtttgcacatcaatatgagtaaacataacatcactgaactatatacttaaaaatggttaggatgaggccaagtgtggtggctcacgcctgtaatcccagcactttgggaggccgaggtgagtggatcacctgaggtcaggagttcgagaccagcctggccaacatggtaaaaccccatctctactaaaaatacaaaaattagctgggcatggtggtgcatgtctgtaatcccagctactagggaggctgaggcaggagaatcacttgaacctgggaggcagaggttgcagcgagtcaagatcgcaccaccgcactccagcctgggtgacagagtgagactccatctcaaaaaaaaaaaaaaaaaacaagttaggatggtattttatattacgtgtatcataccactttttttttttttttctcaaaaagactgctctaaactgagagctcttgcagagcaaagaccacatcaggtacattcttgcggctggtgctggggaggagctcaacagatgtctgcccgcgacagctcagcaggtgggatgggtgatcggctgcctcccgctggctgtggctaacacttctagaagccctgcacaccggagagtaagcaaccagcccaagcctggctaaaaccaaaaacaataaaaagcctcgagaactgagaatgtggaggaggaagacaggacaaaaataaatccagtcactgctgtggtcaagaagaggtggctttcacccattcctcaaaggaacctcgaaagggaacgaaaggccccgatgttaattttagaaatagcttgaagccctgtccaacttgagagtgactctgtgcctcttccacagcttaaagtacctggactttttgacagttgtgctcctctgctgccaaatgaatgggggttgtaatccacttgaggatcttttaaacttcactgctgtttgtatgaatttggaaggaaaaaccaaacctcctctgagagctgactcacgtccctttgggcattgtgccaggccctcagaaatcacctcatctgccaacccatctataataccctgtctgtaaaagcatccttctgcttccactggccaggaagatcgcaaaggaaaccatgtaattgcaagaaaagccaagtcagagaggcaggtgacacgtgttttatgaccaatgaggggcaaagccatagaaagttcagaactgagagtgggtgggagcataaatcctgttgccattgtggtaaaaatgggtggcactcactgtgggaaccttgaaagggaacagagtgccacgatgctgctttgcagagggtcaggtggtcacacagcatcctggggtggtttattccctccgggtctcccccgtctgccatgttccaacaaccatcccagatcctcctccctctaattgggatcatattaaatagcctttccaccagtgacagaaggaggtgggctcttagtggagcccactctgtaaatatagagtaacaacaggaatcagaatgttccactggaaacaggtgggacttgtcctccccatacagactatagaagatgtttacaggactttctgcaaccatcctcatcaagtataatcccagaaaagtaacagcaagctgatgggtttattcaggtaatatccaggagacatatttctctttaaaaggaaaaggaatttgcatgttttgttatggccatcccttattccagtttaactggtccctaagaggctctaactacagcaagagggattttggttagagagattgtcaaaccttgaagaagggtagagacggaaagagagagaatttgagggaagattcctcccagggaaatgttttcaaaatgaaatctggacctattcatgtgggagagaatgcccaccccagaagcaggggattgacctatatgggctccgaagttcttttcatgctgtttccattgagctgccttcccttgcctgtgatgcaggcagaagtttgattttttttctatccctgaaggtgttggcaaaacagaaagtttctctccttcagccaggtctcaggcaacttctagtgtgtatttccccacccttttcatttcccagccagagaaaggggagttcctttagttgtggtcctcggttctgtaccaagagcaggaagctcctaaccccaaaccatcgcactcaggaatattctcaccacaaacacctagaagccaatctttccactccaaatggagatggacaggtcaatcagaaagaacgggctattgaaaagctgtaataaatcatgtgccaagtgaggtgtcagacatgcaaaccagggaatacaaagtcagagagttgtaaatgaagtagtgggttgaagagctagcagtggcctggttctctctgcccacagcaaaggcccagagccagcttgtgcaccacccctcctcttggccaggaaggtacccaaatgtctgttccttggtaagaggctgaccctgaaaagtttacacctggagtttcatccctgtatcttaaagcaaatggggtgatggggagggatgtcgggggcatgggagggtggcagaccccaatgcagcctagagacaaagccaccaggcttgggaattaacagactccatttaaaagttataaaccacctaaaaggattaccattaatgacagtgattaatgcaaactgcaaagtagcaataaatcattaattatactttcaatttttaaaaactccaacaaatcaatattaaatcttacagaacttattcactatgctggggactgttacccaactgttgtggggggaaaggcagaaatagaacacaaaaagcctgcagtgaaatacctctaagaatggctggagtagttaacttagcttgacttgacctcgttaacgtagttgactaagctgacttagtcaaggaatactaaagacctgcagttggaaacccgacctgccccagatctccaaagtcagtgtggaggcggattcattccagggtttgcacataatctgggtgggagagcatccgtcattccatcacactggatcctttcccccatgcatgcctttgttcctcactgatgcatccagccctcgaatgtgcacagcactgtcccagggctagaggttctgcctggtggtttcctgttgtgcgtagaatgtagacaaatcctcttcccaggaccaccaaggctgttgtgctcatctccttcttgacacacaatctttccgaatgctgttccctctgcctagaatgttcttcccttcactctatgtcaagttaatcctattcatcctctgactggatcaatctaggctccttggagtacttaccacagttgtaattttacagtcatttgtgcaattatctgactaatgtctggcctgttctgaggctataagctgcttgaggacagagaccatgtctgtttctatgtccatgttttccccagagcttgcccttaaacatagatgcttaataaacacttgatgaatgaaaaaatgaggcacacctcaaaggagctcaaggtcctggtgggagagactctctttggctctccatgtaaatgactccatcagccctctgctgcaagatcagtcttgcttgtgaagaactgagtcctctgatgggatcagggaccctctgagaggagaaaaaacttgcattatagagggtagactattgttatgctctttattatctttgactattgcctttctggtctccctttgaattagtagattattcagctgtcttgaggcccacaaggaacaggcattttggtccatggatcaaccatggaccaaaggtggacctctgtggagggctcattcacagaggtgcaggagcagcagtatgcctgaggctaggcattgtgcatggaggtggcactggagggaggaaggactttgagcccatctagaaagaatgctgggatcgattggttatgtctgttatggatgcagcatgggaacccagtagcgagcctgtcacacattgaccaggcatactctgaggaggcagggagctcgttttcactgacttcctagagagctctttttcatccaatccctgaggatgtctgctctgtgtaataaggggggctatttcttcacagttagttgtcatggctggatttcccatagctgggtggttccataagtagcctatacttagttactgagacaggcataaatttaggtctttcacatttacacggaaaattctctgaaacgagtcctgtgagagaatgacatcctaacgtgcccaggaaagcagagggaccaccatgcccgtcgcccagcccctgtggtctgtgacacttgtgcagccgctggctaaccaaaaactgaaggtctgggattagattgcctttgcgtaatctgggaagccaagtcccttttctgactggcttctgaagaaagaatctggtcacccattggtaggctgactgcgtgaaagaacgcactttgcaaacataagagcacacacaggggccaccccacaaagccacctctgcagtggtagtgtcgagtcccccacctactgatcacaacgtggtaaggcttctctgaaggttccaggaccatcaattcatgtctggaagtacggtggaagctgcacatcattcactgctgtgccacacattccctgagccacccttctgtcagatgctgtataaggcatggggactcaaagaggcacgggcctggaccaccctcatataactcagtaaatgagcagtgatgtaaacagaggaatatattgcatataagaggtgcagcaagagacgtctgtatgcatgaggctccgtgggggcactgaaagttggtgggggtgggtcagggaggacagctcaggcttaagagatgagaacagcacttggaaggaggagcagtacatgcagaggcccagagacgtggacctgtggggcacaggggactccagggtaatgggcacaggggactccaggttgactggcacagtgttccaggaggaaatggcacagatgtggccgcagagcagggcagggccaattctggagggctctatctgcccccctggggagtctagactgtattctaaggacaaggaggagcagccaaaagttttcagacaaggacaaggtccagtgtgtgtgtctgttggattcctcacagctgtgacgatgaggtgaggtggtgcagaaagggtgaggaggcagggtacaagttagaggcttccctaacagtccacataagacctggtgttgggggatgagtggaggtggcgaatactgcaatcgaaaggtaatttatgcccactggaaaataccttggaagatatacactcagcagtgacggagaaagagctcataaattcttattgccaggtccacatttctccaagagtctggcctcccaggaccattttcctggtctccactccagatctgaattcttgcccctcccctggtctccatagctctttgttattagtctgtcttctttgaattacagtccacagaatatcatctcccacccgtctgggaagaggttgagggcagagctggcattccacgtctctgtatttcccattggtgccaaacatacacacgcacgtacagacatgctttcatgcacacagagatgtctagatatcattttttattgggtaaaaaaaaaatttaggtgcagggactgcccaagttacaattcatctggctgcataggctcacggtgaactagttacaaatttgtggtttgggagacaagtcatgattcaaccgattcaaccgattgtgtccgtaaagcagctgggttcagaagtgtctgaagctgggggcccctgccgctgtcagcatgccagctcaccggtcgatgtgcacagcgaacgctggccaagctgtgcaaggcactccggtggcattggtcaataatggggcaggcaatgaggcagcgcccagaggataagacacatctttttttgattgtgtggcttgttttcttgaggaatgaaagggttttccaaatgaagatagtagaatggaaacaaatgcaaaaccagaaatgaaaaaggcgtttgggatctaggacttaaatgtatctaatcccggtgtgcttgtggacatgggggtgatctgcttggcttcatcagcagcctgcgacaactagtggcctacaaaaagctagccctgcgacagtgtcatctcactcccaatgaagccagtctccgaaggagaggagagggtaagaccatctagaatatccacctcgtccctccccctagaacaggagacagagacagcagtgaggctgggctcacaggtctggccttggggtcccttaatgctcatactaatggttaccatattacctgacattctgtagtaggttgtcctaatttctgtagataatcaaggatggtggaaaaaacctggacttcggagtcaggcagagtagggttcgaattctgactcctccactgactggctgtgtgattttgggcaagttaattaacctctctgagcctcactttcctgaggagataatactgtagtacatagcgaaaggaagtattaatagaaataaatctcacaataccaaagtaactttcagaggtcgcccttgaagctacaaccctaattcatttcttcctccatgaccccccatcactgccacattccgttctttgtctgcatctgaatttacacggacttatttgattgattccttgttattgcctgtccctgtgccttcccactagcctggaagctctatgagggcagggatcatatctgtcctgttcattagtgtgtccccagtgccaggaacagtgtaagcactctttcaatttttggtaaatgaattgaatgagaaacacaaagcttggcatatagcagatgctggaggaattctgatcagtgtgaccccagagacctagaaggaccagaggcgtggacacaggggtgtggctctgcctgagcaagtctctgtaacttgctgtgtggacttttaggtgtcttctctctctaggcctcagtttcctcatctgttcaataagaaggatggtctgatgatgatcactgaggccttctccagcactctctggctctaattgtcttggatcctccacatgggctctggactaaatagaacaggaaatccagctccatcactggagcctccatttgtaactttcagctccatgactgccatactaaatcatcccgagaggccagggtacaattcctgggacagggtagatattgcaaattgccagcagcaactggtagccccacttctccactcccccaacccttatggcccagccaccctcttggactcaccaagacacatctgttagcctcagacctggtttgaacaaacaggaagaaaggaaggacagaaaataggtgggcattgacctgtaccaggccctatgccaggtgctctgacacacagtgcttgcctggtcctctccatagctcaggaacatcattatccccattcacagatgaggagaaggtatattagttatacccatgaaggcagcaaatagcgaggcaggacattcgccaagccttctaactcaaagtctcacacattgaacaatttggtggagtttacaccctaggcctcttatctctgactattaatcaggctattcccaagtgtaatttatggcaagaatacactactaattcaggagcagcctctatgggagacattgtttacactaatgtagtaataagagcaaagaaaagagctgacatttcttaagggtaatggggaccacagtgacaaacacatcacaagcattctctggttttgtccccacaaaaactcaatgagtaggcactgacactgtacctactttgcagattaggggcacgagacttacagagtgtgtgaagttacacaactaagaagtggtggagccaaaattcaaatcctagtctctagttccaggccttccatcctaccacctcactatactgtgggcagactggtgagaccattgctatgaactaacagtcaattacacaacactgacacttattgcatttttttttttttttttttgagacagagtccactctgtcacccaggctggagtgcagtggcacaatcttggctcactgcaacctctgcctcttgggttcaagccattctcctgactcagcctcccaagtagctgggtttataggtatgcacaaccatgcctggctaatttttgtatttttagtagagatggggtttcaccatgttggccaggctggtctcgaactcctgacttcaagtgatctgcctgcctcagtctcccaaagtgctgggattacaggcatgtgccaccatgcctggcctaaagcacactttaaataatgatttatactaacacagttcttattatatgatcaaactgaaaggaaaagaggtcagtggtctccagtctcagccagcattaatgccaaatggattgggtcatactgtgggattaggtcacactgtcggattaggtcaagggctcaagatcactgtcactcattggatgaatgcacagcagtgccaggcatctccgtgttctagccagggcacctctagagattatccctgtgaactgtccaaagagcgtagccagagtctccagaaaacgagggcaggctgacccgcttttggagcccacagagactttcaacccataaagtgaagccaccagggttgtgtcccctcccctgcatagggtcatgtaggaatttgctggaaatgccctagagtgcagttgaaaaggcttagctcctactgaaagcaaggagagcctccactgcctccttcctgaatccgcaagtgccctggggtggggagacctgtgcccctacagcggacagccagctgatcgtggtctggagcttcttggtcagcatggtggcctcatcccacaagagatctggcagcagagcatgggacccaggaaaggtcactgagattagttctgtagctgagcatgaaactgactttgtgctggggcaactgcagctctgcatcccacgttgggaggcagccaccccaccttttgctgcctgcatggtcctgggcaggtcccttgacctggcagcacctcagctgcctcacctgtaaacggaggccacattcatccactcacatgcaggcgaagggtgtgacgtatgcatgggaaacagcctcgttgaactgtagattcctgaacgaatgtaagggagtttgattttcttattttggatcccaaagtcatcattgtcattgtgctgttgtgatgattcattggctgtgttcttacagaatgggacatataagcagctcacttggaaataaaggggagagcttgtcccagatcacagccacagtctggaatcatgagggccacctgcccctgcttgagaaggtgtaagtttcttccttcacccatccattctatcgcagatggatttccattgctttcccaccagggccaagctcctgtgctgatattggtacacggcggtggccccctagctttgctctgtcctcacagagctgttgctctaccacaggacacagataaggagtccagaattggctcagaggatctttctggcccaaaccctcacccaggagatgggtgctcagggccggtgattgttaagagatcccagtacagagctccgagctggccttgttataacctggtgaggatgctagacccacaggaaaagcagacaccaccccaccctgagaagactgacactggcacctcctacctgggcaccagttctgatgccagccagcctgagaaagtgacttcctgggggcccattaagcaggagttccttccctagactccaggcttcaccgggagatgcctgttaggaggaaacagattaggactgtatccatcaccaggtatggtacctcacgcctgtaatcccagcactttgggaggccaagtcaggcagatggcttgagctcacgagtttgagaccaggctgggcaacatagcaaaaccccatctctacaaaaaatacaaagattagccgggcatgattgtgcgcgcctgtagtcccagctgcttgggaagctgaagtcggaagatggcttgagcctgggaggtggaggttgcagtgagccaagatggtgccacttccctccaaccagaccttatcccccgctcaaaaagagaaagaaaaagattctatacaccaagctggccagtggactccagcctccgtcctcctttctttaggattctgggggagatgaggaaaggaggtgggggggagagcctcacccccaacacaggaggccgttcaattttacctggaaagccctgcttcttttctcactgtccccagctaaagggaaccatttatcccggcaaagtagaagaaggccgtttgcattctgaaatgaagcatcagcgtgcaatgacagttaaggtcccaagatacccccggagtcactttttattcttttctatccacaatcattaggggaaaatctctctgcagcttctgtaaaacccattcactagagggaaatagatcaatgagaaagccagagcccagagagcctgtgctggcggctctgaagcaagaacatccattcttccccaagagcctacgccaaaaggacaaaggatgctcgctcccaccccctgaaagaagagttagccaaaaaagttctttaactaggaatctatttcttatcctttattcagtaagaacaaaatctctttctgagagtgacatatcttacacttcaaacaagtgcaacttttgccacttatttttaagtgcgcttgcctgccaaagggatagcaggaatccagggggaggaagaggcaagatggtggaggcacagctgtttccatagctggcatctctagccaacagctgcaggacctggaagagcttgaagagctgacacccccggaggatgcacaaccccggagtgaaagactcggcctccggggctctgtttgctgatgtcagcaccaagtcggggcgcgccaggaacgctctcagcagtctgatgggagtgggcatgcaggcagcagaagaggaaggggccaacccacaagagcaagggaataagaacatggcctttgttcacttgtttcttgattggacaattattagcacttactgcatgcggggcactggcagtaggggtgagatgaaataataatagtaacaaaaacaatagcagctaccatactgaattcctaccctgtaccactgctttctgagcattatttcatgtaatgggcacagcaacccctttaggaaggtactgatattagatgaagaaactgaggcagagaggtttaaacaactagtccaacagctaataaaaggcagagctgggatttaaacgtggatctatttgactcttggctagagaaagacaaatggttgatgtgggcttactgagcttctcagtatgagcaaggcaccaaacctgcatggagctcaagccactaccccgcacccaggagctcactccagagccaggaaggaggggagtttgaaaaaacacagggagcaggggtgggtaagatctattctcaccccaggtgttcagtgacctcagggcagctggccaggggcagggcccaggaagtatggagcccagccctgctgtagagcctgatgtccaagctcaggggctcagcattatccagaaatcaccagatggtaagaaatcaccagtggtgaacagaggatgacctactcagtcatggtttaggaagaccaacagctgcagactaatatggataacccaagaatatgaggcaaaatacaatttctacactattaaagaaaaaaaaaagatccattcatcaaaaccctccagccagggctaggcatgagacttaaccccagggacctgaatgttcccacacagctccacctactaacatgggtgtgcatggagccccatccaagaggcagacccacacaggcccagtggcttcggcctgggtttcctctggctgtcactgttaggctcctttcctggccatattctccagctgcaccagcctttctacttagttgttctgcctggttggaggggagaggctctctgtctttgtgagggcccttttcacgccgtgcatgacaccttcccactctggcctctctcatagctcactgaggctgtgccaagtgccttatgttagggatggagcaattcaccatggagtcacctgggctgcagctgtatgtactggacttcagactgtggccaggctttgtgaagtggctcaaaaatgcccccaggccctagacaccaatgagcctgagggccctccttccctgcccagagtcctagtgactctggaagcctagaaacaaaaacagacatttctgaccactagcagggcacagggatgggttagcaaggctttcacgcaagccccaggctactgtaaacattttgccacaagcaacactgggctgcagatgaaaaaggccagcagtatggagcaggttgctccaacagaggcagtgacactctgagctataggtcagcagtgacacctgtcatttggggatgatctggtgtcattattagctcagtaagccctttataaataaacacgttcatcaacatctgtctgccttgagacagttgtttttcttcaaaacacaaaaactcacaagcccatcaaacatttgcctgccccactgtagtccccaggcagacatgagtttgcatccttcacgtggcatattttacagttagaaaccaaggagcgttgagtcctgtttttaagtgtgtttgaccaagagggaatgggaaacatgccagggtgtgatgtggccctgggcagtgtacagctgttcccacagctgacggagattcctacagttgcccgccacaccggccagcaagctgttaatctgagcgagagatgtgtgaccatttggctggaggggacaggaaggaggcatctgcccaggcagcaaccattctctctacagagcctcacacaccaaggattcacccctccctcctttcccactcacccatggccaccttaccacatgagcattcccagaggaacattttccaatccctgcctgtgtgggcttttaagaccccgtctccccgtgcaactctgcattttccttggatgtcccttttgattgctgtcattgctcccttgttggcatgacacgtcctcctttaccaccctctgcagtggactccagccgctctctgggatgcaccttgaaaggagggtagggctaggatttgaagagactggctgttttcttggagaaagccaccccgttcctctccctgtgaggggcatttgcagcaggaactgggatgccactgacacctttcagattaatgcgttcactcacaaacactaacacaattggctcgaattcacaactcatgaaatgagtctaaggggcttaacagggtgttacagcccacagcttcgcaaatgcggatggatggcaggacaaaacgcactaagagttttttattagtgcttagaattcatgatatgccttcacgaccatggtgaatccccacatcatgatgtccccatctttattattccacagcaacgtggttccaagtcaacactgtattatatcattaattagctgttcacctatttgactccttcccttctccttaccagccctctccctcccaagaccatgaactatttgaaggcagagaacacatcttattctttcccatcctggcactgagtagggaatcggtatctgctgaaattaactgaatcccacagatctcggtgaagacaagagtagtagcaatactggtaacatgagcaaatacatagtcctaatcccttttacatatatgaaagcattagttctcacaccaaccctaggtaacggctattctgatccctattttatagatgaggaaactgaggcacagaaagctagaatcgttcaccccaagctcagtcaggaactggcagggttcggctttgcacccaggcagtctggctccagagtcagacctccaaccctctgcacacactgcctttcaagctgaactgatgcagacaccgaaaacatagtgaattacattttcaaggaaagactctatagaaatatagcatatacaaagaggacattaaaacaattctattctgcagacagccatgcaagaggggcgtgagagatgccagaggagagaatatgccccatttcccatgggagggtcctctctacacatctaatgctgctcggcacacagtcagggttcgagtgaggcggtgaagaggaaacagggggacctgggcgttcagggaaaaggcccaaaaggtgggaggggtgtgttctgggcatggtctaatcagactatggacacaattgtcaggtagggggaatggctgtggccatgggttagttcagggcaatgattctcacattctgatgcactttcaaatcacctggggagcttggaaaaatcgcctctattcaatgcctcccctgagcaattgagcaattgagcaattaaatcagaatccctaggggtgggactcaggcaccagtattattttaaagctcccagggcaattacaaactactttttctcaatccaaatgtgagaagcactggttcagagtttatgcagtattattcaccagtctcttctctgcattatgaactaaaacggtgtgtggggattccaatgggtgggctcttttgatctctacttctcccgctgtggtcggctgtttggggccattctgtgggaatgagctttctctgggtttctagggggccctttagggtagtagtagacttcagattgtgcagctccagttcaaattccaaccttgccacttaccggctgtgtgactttgggtatgtgatctaataccctagcctcagtttcctcatctacaaatagaggattgtggtaggcagaataatggccccccaaaatgtctgtgtccaaatcaccagaacctgtgactatgttataagcaggaattaaggatgcagatagaattaaggccgctaatcagttgactttaaaatagggagattatcctggattatctagatgggcacaacataatgacagggatccttaaatatggaaaagagaagcaggagagtcagtgtcagagtgatgtgatgtgaggcttcctagagccccgtgatgtccgtgaacactgcacgaactagtgtttctacttccagactctattcatgagaaacaacaggaaatggggccgttgtggggtatgggtaggagaagtggaaggttgagaagggaggcccctagggagtgttcctggtcaccagctaagaagggaccgtggacattgtcagcaaggactttggagagttcatctcaaggtgttgggtaccccacctgctgccaagaacaggcaagagctgcaccactgtgcaccagcaaagggctggatttgcagtggtgatctccttagcaaggagagtccaaaattaaagtcaccgaagtctcttgtttgtgccaggccctggtgggccctttaacccagctctctcagctgatgctcacaacatcagcatgtggccagcattatgacctgtttatacagaggaggaaacagactcagggaaattcagtgatttgcccgaggtcacccattagacggcagcagagctgagattagaactcttgattctaaatctagaatcttccatgtcataccatatttcattttcttttcataaaggcctaattaatactgcagtcattattgattcaatcctgagagcatgagaacacagccagtacagactattaatctgcatttcctccttgagatgtgccagccataaaaaatgtagcagcttcaaaaactacaaactagaaaggggcctaaaggaaatttggtgcccaatgaataaatcttatgtcagctcaggattgttgtaattgcagttctgtataatgttcataaggcttgggtttcctgcggtccctgaaatcgaccagggaggtgaggaaggaagcagccattccccaccagggtgcccaaggactcccaccaaattagaatgtggtcccagccccgggaactaaatttatcctgaaaggacatttggatcagaatgttctctgctacaagagatcctgtccctcattgtcctcctctttctcttcttccagagccaggcagtattggctgtaaaactcagccctgtcaattcagcttgaaaaccacacatacacatgcagtcaacccgcagcaacagacaccacatgtttagatttgaaagatgggaaagactgaggcaagcaggaaaggagaggccgaggacatacagagaaggtgaaacaaggtggttttggtgaagctgagcgcagggtcaaagaggaactgagaagaggaaaaaatgtcccctggtggctgtggacaactcgagcccgtaacccaacagcagctggggcaagtcattccctctacagcgccagctgctccttcccaagccacgcagctcctcctacctgcccccgcacttcaaccttttgagcccacttaacactcagaagccccccgcacaaagtcggctttgggtgatgtcactgctgctgcgggtgacagccaggccctggggatagaagcctgctctgggatggtggcggtttccagccaccccaccaaacctgcaaggttgaattctgcaggcaaaggaaggatgtaaactccctgcctgggggagaagctaagtccccgaggctgctggagaagagtgtatttttaggcataggcttgatttgtgaacaataagggaagagcaaaattgtaaaatcctaaggttcttgtgaagtctgatcagtgtcgctcctgctaaacatccaaaaagatccgacagagcaagacaaactcgggctgccctcaagccctggctcctggttgggtggtgttcagtcagtgagatcagaacctcagcgttttggggtgggaggggtgtttttccattcctctgactcttaaacaagagtgtaccaggtggctctcatctttaatcctaacaatctcccaaggagggagattcatccaccattcctctagcccaaccctgtactctaaggtcagagcaggtcccagtgattgaggggggttcaacctgtaccataatctacacccgtctcccatccccattcttacctctcagtctttgatacagactattgacattctctccatcttacataaaatgctttgcaggtgcaacctgaagacaaattccctggcttccctctcccgccatcagatcgccatcccccaaccccttctcatagatagaatggggctactaccattttagacctgggtgcctcatcgctccagctgctgctcaccaggatctggctccagcccttctttctattctcacctttcaacattccctttacgatcagctgcatgcctcccattccgcagagccctgagcttctgcattcttcacagctgctggagctggtcccttcccctagaggaccctcgacccacctgcacctgctagaactgaccccatgaccatctcagatgccctgcacagcagcgtcctcattcccatctaggtggaactgtgcgccgtgccctccacacccttgtcctcagcaccagcagccaaggcgtgtgtgtctgcgtgcttatctctccattagatcacaagcctgtttagggcagggaccttgctgtccccacggtgcctggctcagaacagcccttcaatagctctgtgctgaatgaattaatcaccttttgtccagtcctcaggggagagaatagttgctatttctaacagcagcaggaagacaaatatcgccctgcccactcccccgcctcccattccacacatacacacccactggtggcaatttctctttgctctcaaatcgatatggtttctagcacattctagcaagaagcaccataaagagctgatagggaccttggagagcccttagcttcctccccagatgcacaagtgagggatctgagggcagtgaggggcagggtctgctggcgatcacacagcaggcaggtgtcgggcggctcccgcagagccgcctcgtggctctgagttcagaggcggtggctgctctgcgcccactggatggctccgccgtgtctggttactgatctctggtttgtggctgtgcctgatgtagtcacaggtcagtggtcatagccaggcccagctgctgtggctgagcagtgtctctgagaacgtccagccacggtggccatgcctcagcactctcctgtgacacaacgtgatctcaccgagtgaccaggtgtacggcttcacccgtccatttcacagactcaacactcagccccagcagccaagccccagcaccagcagccacgctttcatttcacagactgtgagtaacacgagaccgggtccagtctgtagttcacagctctgtcccataccaggcaccgtgcccctcacagagcatggctcaataaacacgtgttctatgaatgcagagcaggcttatttgggggctggggtgggagggcacataaaactacaacctcacaggaggccacaaaacttttaagatgaaaaagatttgcaaatccttgaagtttcttctttacttctcctgtctttagtccaaccaaagaaagtttacctcccagatttgacttctggttcgacatttgtatcaatggtttagatgaagctattatactcaggctcatcacatgtgggagggcaggaagctgggaggcccccaaatacatgttgctgagtgagatgctaaaaggcctggacagactagaatgaagggctgaaacagctgcagggaaacgtaacagaagaaaatgaaaggtacagttctcacctaaaaagccaacggtattaggaaggatgggagattgagggggcagagggtggggagctgcttagcagctcatgagaagacagaggggttttagtaaatattcaattcaatataaactaacaggctaccatgaaagctaaaagtcactggctgtctttggctgcagtaacaaagtgagaaagcaggtcggtgccttctgtactgacctgatcccagtggtgtgtaagggtcagtgtgtcaccagatccctgggctgctgtggaccaagcagatcctgttcagagtagcaagatcagggtggaaacaggattattgacatgattatggcagggaagtgggggcatttaatctagggaagtcctgggtccagcttaggggagtttgggtggaaggctgctggcaccttaccataggaacgggcagaaggaggggagaatatgggcggggaaacaggaagagctgctgaagcctgactcacccaggccactggcagcccaaggcacagtgtctaagggaaagaccagactcagcccaggcagatgatggcttggggttagaggcaggtctgatcctgagggcctggggactatcagggacactgtgactccaggcgagcagaagtagaagtcagcccctcagaaggcagggaggcaagaaagaacaagacccagtatggggctcagtgaggcttcaaggaagaccctagccttccttgggatcagaaggcaaggcagagaaactgaagcgggtcccagttctgatggctgggcaggttaccctgagatggctgcccttctacctccccaagggtgctgggcctcatccttgaggcaagccttggacccaaggggaggacaatagggaaaccaggagaaggaagggattttaataggcagaggagccaccacaaggcacagccaaggtgggggtgtggctgggatgagggcctccagagctgctgcaaggttggaccaacactgggttactgttcagccctaggcttcctaatattcacccttgttggagggaagtccccatgactcagcccaccttctaggctgcttctagccattgtaggaaccaggggtagaagagttaatttgaggacgggcctctctcccccaggcagggcaacctggctagctttggagatggtcaactcaaacagttgacctcaaaaccctctgccctcaccagccacatgactgtggacacatctcttaccttctctgcttcagttgctttatctataaagggggtatgaatacagagcctaactacgggactgtcgccaagaatcactgagatgataaagtaaaggcacagtctccagcacacaagagatcaacagatggaggcgacactattaccacctgtgggattaccaaccacttccccaatcgaaacttggaatcagaaccccggcccgtgacgttagggcgatgggacagggtaaaggtaagtttaggggctgacaaagtgggagatgcttgtggagatgatgtgcgaagagagctcaccacaagccttggtggaggcacacaaggccacacagaaaatgacaaaagtcagttctggagatggatggtggtgacaaatatacaataataaggatacaaatatatatataagaatataattagacaattaacgtcactgaaccatatacttaaaaatggttaaaatgctaaattataggttatgtatattttaccacaagtttaaaaagtgttttaaatgaacaagtctcaacttggacccaggtctacggaccgcaggctcagtgtctctcccaccatcatgctaacaggacaggtttgtatgggagatgcctttggaggaaacaaaactgctcaattgaattgcatcgaattctttaattcaaaggtaaatcggggcagttcatctcttttcctcgtccaattgttgggttttggagaatttgagcagtggtgattttgccattttttctcttaaaaacaggaaaatgtcattttactagatttgtactcaacaggaaactagaattatcagaattttcttgatagcacaatgcaacaacacttgtatagaagcctccaaacactaaagattcaacagtgccttccaactttacaaattctcagagagtcaatgatccttaccccaggagtcactgagtcctactatgcacagtgctcttcgttaggcacagcaggggtggctgcagggatgattgggaagacgctggcctccctgagcttaattgagtgccatgtttcttaataagagtgtgcactggcccccctgcggtgctgtcaaaacacacattcccaggcagtggggttcacctgcctatgcaggacccagatatgacacgggggatctgaggcacacccctgattgagaaccgctgccacgggggaaatgatcatcattgaaaaatggtaacaacaaaaccaaatagaacggattaactttgaaaaagtcagggatgacacaccttggcactctcagagaaacagaatattctttttttttctttttttttatactttaagttttagggtacatgtgcacaacgtgcaggtttgttacatatgtatacatgtgccatgttggtgtgctgcacccattaactcgtcatttacattaggtatatctcctaacgctatccctcccccatccccccaccccacaacaggccccggtgtgtgatgttccccttcctgtgtccatgtgttctcattgttcaatcccacctgtgagtgagaacatgcggtgtttggttttttgtccttgcgatagtttgctgagaatgatggagaaacagaatattctattaagctgagcacttgttccccatgactttggagaagtgggagtgcgcgttcatggaaggagtttggaatggattgttaaggcaggggacttggccacttactctattatcctgaaaactttaagctgtctgaccagctcctgtgtgtaagagactcaagaggagtcacctttaaactttaagatgttggagccaaagagctgtctttattattgttttctatgtcaagtttgaggctgtgtttaggggacagccagctctgtgactgggcagaggcaaggctattaagagaagggacagaagttgttcggacagtcccacaaagggcctcctgaacacaaaccaggtcagtcattgttaccaaaaaccgctcacagccactctcccgacattttcctctccttgtcaggcagtgcccctcagacatggaattctggctacaatcagagttctcagagatcctctggcctaatctgcccactttacagacaacacaactgagattgagctagaacaagtagcttgtccaagctcacaagtgatcagcatcccagacaaactggccctggcctctcgtcccatgtagaatgggcagagggttgctggggtgggagccccttgggcagggcagttgttaggctgctttttttttttttttttttttttgaacattttcattctctcagctgcccatgctgggactgtgattttttgtatcctgagttacactggaagcttcctgagaagcgtgtccacggccccctcacttcacatggcctagggcgaggacaagtgtgtggtttccaaggtaacacatagctgggtggattcagcctcccgggccgcctcctcttcctgggaggcttcatcttaagcccgcaggggaggaggcgtgggaggccaggcgacgcaccgccttcccattcacaaacacggactcttcccgaaaccagtctcccctctgtcctcctgccagggttcaagggcagatgacccctccccaccccgtcctgaactcctggagctaaggaagctcctggaggacttggcaagaggcgtttgcctggaagtcaacagaaccccagctgacggggaggtcaagccttaacatgcccggagcagggcttttcacacctgttaatggacacagcaccacccagtgagagcatgatccaggatgacattccccagagacaaaacagaaagtcaatacaggcagccgagaaacaagccttgctgccaccacgagcacacccaccccatcggagacgccagccagggccagggagagcagccgggggccctcacacctgagggacagggagcaggggcaggaaagccccctctgaggcagaaagggttaagcccaagtgtttaaatgtttagcaaataaaaccaaaatgtcacacagagactgccagggctggtgtagtaaccatggcaatccatggccagcggccgatccaagtgaaaaggtgctgggatcgaggtgggcctcccagagagtggcagggagggccatggtgggcatggccagctcactgggcaacctgctgggacccgcagccccttaggatgcagaaagcacgggccagatgccaggtctgtgggcttcaggtcaggctctcagcctgttagaggctctactttctccttagaatgaggagggagtaaatctgccatgcctaccccagttttgtcattcattcattcatttattcagcctacactcattgaatagcacctactatgtgctaggcactctcatgcctttgggggtccaacagtgaaaccaatacagtccccactgccatggagcccacagtcagagaagggagttgcaggcaagaaatagtattcacaaccaacataagacacgcagggacaagtaagagccgctgctataagagctggtgctaggtccactcctagaaggggcaccctggggtcagggaagggggacgatggccagagagagttcctggaggaggaaatatctatgctgaaacctaaaaggcaaaaaggtgaaggcggccaggcccaaggcctcatagatgtgaaaaccctctaaaaaatacaaagcgctagacaagatgtggccacaccatcgtctctgaggcgcttgctaatgtatcagctctgagctttctgtcttcaaagtgtagtctgacgaggatttattccatggtgttctgacttctcgggcccagttggtggtgtagctcctctctctatttctccctttctttctagccccactgtgcacagctgggccaggcaggaggccgaggcccaaagaagagcagcgctccagtgaatccccatcaccagtcgctgttctctggaacacattccccattttcaatttcccttgtgtgctgtgatcatccaggggcacactcatgaaagtgggacaggagagggatgtaaacctggcagaggaggcccccatctggaatttccttgtcaaggtctcctccccttcagtacgagtggcccgagctccctccttccatctgctcatcacacctgagttaaggagctgacatgctcaaacctagccaggctgagaagtctgtctgggggtctcaagatctcggaggttcaatgaaggtatttctaattcatcaaccaaccagccagagacacccttaggaaacctctaccaggtgtctgaagaaggatggggactctagcccctacctggggggtttgggcagcctccacctcccttcggaggacaggcacagcttccttctctttttttttcctctcctgaaacgctctgggccagctttgtcctgagcatacaaggtctctgctcctggcgaatgcagggcacagcatcatctccgcgtgaaacctgcccagcctctctgggagaaatgcatcactccctcctccgtggccacttggtgtttcacagaccctcatattatggcacttatgaccctgggtcacagtggataaaggtctaggacaaaccaatttccaaaggcaggaatcaggtctgctttatttctggattctcaatgcctagcacaaagtagtcctacaataaatgtttgttgaataagtaaacgaatgaatggactcaccatttttatagactgtactagggttggaaaatttagagaggtcagtacgtgctctgctattataccttgtctctcagtgccaggacaccttacaggttacattcaggatgtgacttgagcctgctttcttttacagggagaagggagggtgagggcacagagcaagacgcaacgtgagttgtcctgtctgttctttcaggggaagacaccactaactcatttagcggtgggaccccaaagcacctgggccagcaacacctcctgcattacagacacccatgtccctgtgacagcacattacacgcacccaggaggacactcccatccacagagcaattatgccacaggaagtgaggcttcctataatttatgtcctgtaatttcaagtaatttccctgtctgctcagaactctattggtatttaatgaaaatatccacttttatatacctaataaattaaaagcctcccctttttttggtcccttgtatttcaaattcatgaggttgaaggcccatagtttgttactaccgttacgtttctgttgagtttgaaaaagactggaaacatctgagaccaacgctagatcttgaggggattgatatccccaggcaagagtggatctccaccccattgatctgattgatgccttttactttgaatatggccaagaaccacaatttgaaattaatgatctctgaagctcccattctgggactggattatatgaactctgccactgctctgtatcccatcctgggtcacagtagtctcttcagtttaattcaataaacattcactgactacctgctacgtgcccggcattggcctggatgtagggacggcacctcccatccctgcaactttattaaggatgccaggctctgctccacgcctccggatgtgaatgtgtctgcaccccaccccttattccatgcctggggctctgagccaggcacttcctcccaggggtactggatccctcccatcctcccttcctcactcctgccccagctctgggcatcaacacccctcacctggcccatgatgacgtgcttcccactgtcctcctgcctctgaaattggcctttcctatatttgcatgctgcagatgaagagtgctgtctaaaatgtaaatctgatcatctctgtccccagcttgaaaccttctcatagtttctgctgctgcctacaggacattccaaaacccttcagcaaggcaaacaagtccctacgggtccttcccaccctccatagtgaacttgcccctctacccaggaccctgtccttgagacattcccagtgtgctctgcagttccccatctcagagcctttgtttactctgagacctctgtctggggtatcctttccactctgtcagccagacaaacacattcttacttaagctaaggagttctgcatatattatctaatttaatctgtacaataaccctttctggtaggtactggttccgggtgggtaggcatattcaaacctacccccaaaggctgaggaagctgaaaggctgaagaaaggggctgacatatccagtttctcagaaagaagcatttaatagggacttatgaacaaaagccacagtctctggcagcagtaagacaagatggtggatcctgcaccacgaccccctagtcccagggattaaataccagaggaaaggggtatatgtgcttcagaagcaatttgcctaagggcaggacttacagtaaacagtagataaaggagaaatcttagaggctttcccgaaactgggttaatcggaagtcaatatggaggatcagcatccaagatggagttgctgtggcctccacagtatggttattagtcctattttacagaaaggaaatagactaagaaggattaagtaacttgctaaaggccacctacacactaaatgtgacaaacagcatgatttgcgccaagctgggctgctctgaagtctacattctcagtagagaacgttcctcaagcctgggtcataactgagttttatgattctgcctgctagcctgccttccaggatggcaccagggccattcattagagccatagattcactcaaggctgatgacccctgggagaagcaatggtgaattctgagtttctcatctagagaactgggctcctgtcctgggctctgcacctagaagaacattattaaatagatgctgaaccaatgactgcacttggtgggtcatcaagggcaaaggaggagaggatactggggagcaagaggagttcagtgttttgtgtgtggagccaggggctgccggtggcatgtaaaacgtgagcctgcagcctggggaggggattagcacggtctgagagctgttggtgagagctaaaccacagaagtaaatggactctccaagggagagcatggttttcagtcagagttttggtaaataaacaaaatgcattgcttcttgtgttttcatttctctcccggacacactggcctgaggaaaagaggtgcctgagtctttgaaaggtccgtgctccaaaacgccaacagagagggagactgaggagagatggggtggggtgccatcttccaacaatggaggctaccatgcgggaaaccaaccccttcttttccctgctccagaagcagaaccaggccagggggcaagttccagggaggctgcctcttctcggcagaagggcgggctttctaaagacattggtagggcagcctctcccaggggggccagcagctccgtcacagtagcacacacagaggccctggggttcctgcactaggtggacactacagtttaaacgtgtcccctccaaaattcagatgttgccaatgtggtagtgccaagagatggggcctttcagagatgttgaggccatgagggctcctcccttgtgaatgggattgaggcctgtatcaaagaggccccatgcagtgttcagtccctcagcctcctgccttccctgcctgaggatgcagcaacgtagcgccgtcttggaagcagagagcagccctcaccagacaactgaagctgctggcaccctaatcttggacttcccgatctccagaactgtgagaaatacatttatgttccttataaattacccagcttgggtgagagttacccaacagtgttttagaattcttcttcctgaaaaactcaagccatctaaatgaacaagtaagaatactgttctaaaaggtactcccccagcctcacatgtgtgctgggcagggcctgggtcctgggtgtgagcttctggggcaaggctggggaagacggggacatgatcatctggtccctgctaaaatttagctaggtgatcaggaaccactgtggatgaggaaagctgtgagcagattcctagcaaaggtcctgacatcacccaaaggggagatgcggcagccaccccctgccctgcctgcttcgcaacaggtgagcagcagctggcctttgcctgtggaagggtgcttgctaagcactcccctctgcataacttcatcagtcacacttgggataactccttcctccactcgcaggaagcaggttccgcagctggctgagcagccagatctaaatcagagaattacaagattggggggctaagtaatagatgaggaaactgaggcccgagaccaaaaagctaagtcaaggtacgaccagctttggaaaagagttaccttgaactcagcatgctttccattcaaagaacgtgctacaaacgtgctatactctgccgagaagagtatactgtcagacactataagtctctggacatgcaaagattaatgcaaagataactgtccctgaggtagggaagaaagacacccaacagaaaactacaatatggcccagtgcggtatatacaagggcgctccgtaggaacctccctcccactgactctctgggcccaaactgttcccatttccctctggcaagagaaggtctagctgggcacagaaagaactttactggaaaggtaagaggcacagaggaagccggttttggtgactttcctcaagtgacggaggctgcagggaggataaggggctgggtggtgggagctcagggtacaggcagggctgggccagagcaggaggaagcccagccacctgccagtaccaggcagtcgtgatagtgaccacctggtggacccagctggtaagtgcaaggcccagctagaagcagtgggacaaaggtcacaggaaagggaccaaagtttccattctgtgaaagcccactctgtactctacactgtttccaacccctgcaagagttcagcaaagtgggtgatgtggttcccatacttcagatggggaaactgagccccagagtcaggattcaacacaactgatttcactttgtttctccaaattgtgtcaggccaaaatgaatgacccccaatagcatcatctactgcccatgattagggctgaaacagagattggccatgagctggacatgggacaatgggtacccagccaggttctgggctgtcagcaacatgaccctgccaccaggccggaactgagtcaagctgcagctggaccagaacaggctgagagctagggctgcaggccctggactgggaacaaggacctcaggagcatcagagggagggacacctggctctacccaccccaatgcctggagcagaaagaggaagtaatcaggcctagcaccaccaaagtgtggggttgaggctgagaacagctcctcttcttccccttcctcaagcctgggtcataactgagttttatggttctgccttttttctttgttgtgtgtgacacctccccacacaggtcagggtgacacatagtaatacagtctccctacagatgagaacatgaacactgagggactgcctggatcccgcggctggctttgggtggggtggaaccaggcccggagcccagactgtcaacttctgtcctgtctcgattccgtggccctagtcctccctgcctgtactcctggctcctttctggggctgactggacaatggtctgagttaaagtccaccactctgtccaattcagactccatgaaggaagctgcctggtggcatctggcacaggcacagcccctgtccaagcatctgcaaccctttagaggctgaagagtcccagcatccaggtcagtatcctctagtcattgacagaatgcagccctgccaaggtggcctggagccaaggcttccatgtcccagccagccacagtggcccctgaccttcagacaaaaagccaaggctctctaagaggaggaggcactcccacctgcgtccgcactgctgctccaccctgaaaatgccgagtaacaaatgggactggatttgaacggtgttgttaaatagcgcttcacaaagcactctcccatgcgctcctcatcccatcctcacaacagctcagcagagctggaataaaggccccatgttctagatgagaagatcgagacccaggaaggtcacagggctggccaaagacacaccaagaaaaaaggtcatggccgagacttgaccccagtttttctgactctgagctctggtcttcgtcaatctctcgcctgctgcccagatgtgaatctatctgtgctcctccagccaaaggaccgggatggtttccagattcacatgcacatgaggaaaaacatctggatagtttagaacttctcaggtccacagcagtgcaggtcagcctgaagggccgggggctgggggaagctcattgtcaccagaagatgcttcagatctgttctctcctgtctgaccctcctggcccgggttgaaccatcctccctatgtcagccaaactggaagtgcaccctggaggcccagccaatgtttctctgggtaccaagtcactcctgggcagcaagaaacagaggccttctcggccacagcagactcttactctgtctagaaaatgacacccccagcctagacccacaagggtgaagaccacaccattcacaaaaagcagactccttggtggagtttggtgcagcatatgtgggggtacacaaggcaggtctgcctcactgaagggatgaactgagtggcccaagttcagaaaggacaagagacacaaaaggcagagcaatgcatcaggggctctcccggtccgatggtgctcagtgagggtcccgaatacggcagcctcgctcaacatgaagccctatgtttgcctctgggatccccactttgaagacaacttaacagttattcgaaagccacagggcggcctcgcagtttcctctcccatttgggtccaaaccagaagagaagagccacgatcttgggcaccgtcttgtaaaatcacccaagtagctgctaagggagtgggttttgggggtggggatgggctcggctcagagcaaggccaaaggatcagccgctgcatgaaggggtgaggtgggggcacctacctggacttcacgtgtgtggtaggcgatgatcaagcccaaaaggatgatggtggacagactgataaggcatttcagggccaacgaaaacatggagtcctgcaggaacaatggagagagagaattagggagtgcggggaaaggagcgtctcactttattctgcggctgtgtaaaagagaaggggtggggacacaggagggactgttaccagcccctcctaggagcaggtgtagcacaaagtcagcctgagccccacaaaagccttgggctgtgcccgggccggctctgtctcagcagctgccccctttgagcctctgttttctcgggctaagtcgtatttgcattcctgggatgaacgctacttgggcatgatgtattatgtttgttatacacggctagattcagtttgctgatgtgttatttagaatttgtgcttccatgctcataactcatatgaacgtcattctttgttgtgccgctattacatggtttgggcatcaatattacgccagcttgggcctctgttttctcttaaacccaaaccagaggatttcggaggcagaattctttcaggaatgaatttgaatgtcccggcagctgctctcatctcctggcttaggccaagggcaggggagggaggcagggacggcagaggagctactggagagagaagccaggaagcacaggagcagagaggggtcctggcaggagaagtaccctgatggtccctcctgctagggattaggtgggggaggtgagccccgtggcctccactgcagcctttcagtcccagggcagcttagagaaaccgagaagtgtggttaagggcatgacctccggggccagactgctgggtcccagccctgcgacagccatttagggctacctgaccttggaacgcccactccacctctctgcaccagcatgcctcctgtgtcagatggagataatattctggactacctcacagggctgttgtgaaaataaaggagttaatgtatgcaaagtgcccagaacagtgcctggccaagtaagtgttaactacccttatcatttactttgcatcctctacaaatcagggtgtctgggttggaacttggtgcacctctgggcatttcgaagctggaagtagagatagctcctagttccaaaggaaggcgggaacacagccctgagcaaaggcagcagatgagatccaggaagcatttccaagcagtgactgtgtgtatggcggccctgcacttggtcctgagtggtgcacgccacaaaagaaacattcccttcctcagggagctggtcattagaagaatgatgcctgatttctggaaggcaccttacagtttacaaggtggtttcacgtatttgttctcatccatcctcacaacagccctcggccttttaccttatagatattacaggctgaggcccagaggagggtgggtggcttgtgccagaattcaaagtcaaggcctctgactcgcagtacagagcactgcccacaagccctcaggcacactctccaatgggaaacaacttagaaacatgggaagcatccatttaaatagacctaaatgacatcttaagacaacaaggtaaggtagagtatgatcaattgccagagtgaaacctacagtagagctaggggagctcaaaggagggaggccactgtggatgggtcagagacagctttcagaggcagatgtgaggagcagctgagatctgtggggtgaggcggtatgtccaatatggcaaccacaagaatgagaggagggcttgggactcgaacccaggacttccaagtgcccaggtccatgctctcggccccactctgtgtgctgagatggaatgaaagtgctctccctgatgtctattaatctccccattcatttaattggtacagttcttgaggcccactggagatacaaagaaaactaataaagtaactaattcattcactctttcacaaaaatttcaaccacttctcatttgctgagcacttgctagatatccaacagtgtgctagattctatatatacagtgatatacaccagaagcttctgatctggcttattcactaactctgactttctacattgcatggggtcgtccaactatgggaaaaggtctccattatttgctatgcataagatgatctacacataagccagtcttcttttagcctcttcatgttccacagttccataagagcagcctgcaatcatttactcagcacacatgtatgggggcctaaggagggctggtgctgttctggtccaacataagcacagagaaggacagaacacagtgctggccctcaaaaatattttgatcttcacaagcacttcctggtgcctgaaatgctacccaaccacaagacccagatggggctgaaaagagcaaatggtgaattcaggaacactcagactgtattagggtaaaacaaacctccctacatcaatcaactggggatcaactggggacagctcacaatgttttccatccagaaatgaccataactttcttttcaaaggggtctgaaagcatctgggagcatcacacctccccgggaaggatttgggatcagctgcacatttcagccccttatttatttcttttggcagcaatgaattgacatcagaatccaagtctatttccatcattttaaaggaagcagtgaagggaaaggggccagatgctctctcctttgggcctcttccttttgtcctaaagctcaaaacctttacatgaacaggcaactcccacctgcttcttggttttggccagtacaacctccctggccagctccagccctgtgggatgaccaagctgtgtgctggatcaacagggactctcgatatcttacagatttctttgcattctccatcgcatgtcaataaaaaaaattaaccaaccgcttttaatagctggaaaacatgtcaaagaagtctggctgaactaggaatgttttctatttggtaaaatgttgaattagcatcttctctttgctgcctgaacatcagtgaagcttgaaattgatatggttccttgggggatggcagtgacaccgggctgccatacatcccaggatagggtacctgccacacgcattgcccccactcactcctatctgaggaccaataaggggcttgtagaacagagggaatccagcggtcaactggtcaacccttctgccccgtgactcagaacttttcaacacagagtaacaatccttaacacacaggaatgcttaggaattatatcccatttgatgagaatcatttttttttttttttttttgagacagagtcttgctctgtctcccagactggagtgcagtggcacgatctcagctcactgcaagctctgcctgccgggttcatgccattctcctgcctcagtctccccagcagctgggactacaggcgcccgccactacacccggctaatttttttgtatttttagtagagatggggtttcaccgtgttagccaggatggtctcgatctcctggcctcaagtgatccacccgcctcggcctcccaaagtgctgggattacaggcgtgagccaccgcgcccagctgagagtcatgttttaaagtcatttattcctaaatgcccacaaattttcaagtggttaagtagatttgagatcaggcagtgatggaacactacgcagccactaaaaacacttctgcacacggccgtaatcccagcactttgggaggccgaggtgggcagatcacgaggtcaggagatcgagaccatcctggctaacacagtgaaacctcatctctactaaaaacacaaaaaattagcgggacgtggtggcaggcgcctgtagtcccagctactcgggagactgaggcaggagaacggcatgaacccgggaggcggagcttgcagtgagccgagacagtgccactgcactccagcctgggtgaagagcgagactccatcttaaaaaaaaacaaaaacaaaaacaaaaacaaaaacaaaaacaaaaaaaaccaaaaaacacttctgcagacaatatctgaagacatggagaatggttgatgatagactattaagtgataaactcagaccccaaaacgatatgtagtatatttccaattatttcatttttaagcttttttagtgtagaaaaagactgaaaatatgtcaatagaattcctaagagctgcctccatccatgtggtccctgttctgctccaggccacgagccagcccttcacagatctgtgatttctcattgatgacaataatctgtaataaagcacatctataggggcctaccatgcaaggatggcattgtcaacccactcttacagaggagaaagcttaagctctcagaagttaggtaacttgtccaagggcatgttacctaacttctcaccatggcaaagccaggatttgcaaaagccaggttttacacccagatctgtctgcctccaggttccattgccccgcctgtgtcccagcaccccacctgctctggcggccacgccttgctggccctccaatatctgcagcgaggcttcttagagctgttccagcctttcctcccctgaggctgtgcagagggtgatggagtgtgttccccagcttctgagccagccacataaattgctctcctggcctgccttgtagcttccaaaaacaggccagaactgtaatgattatggtatatcttcccagagactttgaagttctaaatgtattttattgtttgggtcatcgcaaaaaggagaaagctatgcttacagacagagacctggaggggcactgaaccaaactgaaatattagcttaactgagataatgatgcgcaggctccttccccaaccaagctgttacccacaaagagtatatgtgtatggttgtgtgtgtgtgtgtttatacacatatgtggtccattcacgatttctgtcactggctgaaacccccaaagggaaaaggtgatagtatctgaagttcataatttctgaattaaggtctgatgtgcctgcctgacatcactatgttttgtgcattcaatctgggaaataattgatttagaaatcttttctatctaataaggtcaacttttccttcaatttcatggagaggctccaaaattgattgatattcaacatcggcttatgactgtggttctgtaatggttgtcctaattagatactcttgctaattaatgctatgcaaattaaaccagcccctcttccgctaaagggaagaccgcatcactggtcgctgttctccatggagacctgaggcttctttccctccacatcagcaccaagccctggccttcctcattcctcaatctcacactgtccagttcttgggatctttcattcttacccatcatcctcagctcctatcttagcacagcctcctcctcccaggtgcagcaccctaatttaattgcaagcccaggcgtggtggctcacgcctgtaagtccaacactttgggaggccaaggcaggtggatcacttgaggtcgggagctcaagaccggcctggccatcatggtgaaaccccatctctactaaaaatacaaaaattagctgggcatggtggtgcaagcctgtagtctcagcttctcaggaggctgaggcaggagaatggcttgaacccaggaggcagaagttgcagtgaaccgagatcacaccactgcactccagcctgggagacagagcaagactctgtctcaataataataataataataacaacaacaataataataataattgcagctgttggccctcccagcatcctcagagcggcttcccaacctggctcctaccagaagtcagctaacagaatcctgtttcagtcactaatgaatgaagtgacagaatgaagtcactcagaccctctctctcccaggactgtccaacctgagaccgggagagacagccgatgctgtcacagtgggaagggagactctggggactccagagggcagctggacctctgaccagcctgagaagggagaagggcctgatacttgctagccaagacagctctggaacagaggcccagggtgtgcatccgagggcgcaggagtctcagcctcctccatagtgaatgcctggcctggacaagttgcttccttctcctaagcctcagcccccagtaaaatgagactcctggacagaaccttctccgaagttcagttaagcctgatgaccaaggcgccgagcacacatgccatgacaaacaggtcatagggacatgtccaacactcattcctttttttttttttcttaggagttttcttttcccaggcatttctgtgatgaaatgttgggtgtgaaacggtcagccacaaaacccactcacaccatcttctcctcaaacacaacaaggcaagcttcctatttttagtcatgggggggctaacgaagatgttccttgtctctttctaaataacataggatttgaaaccaaaaggccagagttcaagtcatgtctttgctactaactagctgtgtgacactggatcggtcctttaacctctctgggcctctggtttcttctctgcaaacaagaactacccttacttttctcacagctgttaggggatgagatgagatcatgcatacgaaaaatctcattctgttttcacacaaagagaagcatgcattcccttgtagtcaaacaccccttctcttgccatacagatgtcagtgcaggtaaatgcagctgatcctcagtccggagctgctcactgcacccccaatatcagcattttatggctgcaataatttataaagatatccctgaggcatttcagaaagacacctttgcaatccgcatagccaaacattcattcacttgtgcattcatacaacatatattcactgagcacttaccatgcccaggcactgtgctgggcaattgccaaatgccagggattccccacccgctccaaccccaacctgctgagcctgaatcccatccaggagctcccaggagctcatcccaagggctgccctctgcaccatcatcgccccgtcaccttgacatcccatcctgtccctcttggacactctccctggcctctctgtcctgcccacagtgcaaggtcaagaagagatgggccaagggtcaggtcagggggccctggaggacacatcaggctgggacagccaggaatgggcaggaagcccaggctgagggagaaaacccacaagtggttcctttgcgctcgagtgaccagctctctccacggcagagctcaagaatggatattagaggccaagctccaggaacctttcctgcctgcctgagcccactgtgtgggtgaggacatctttaccacaggtcccaggggctggagatggggctaaacctcactgccaccttttctccagcccagtcaccttcttacatgaagcttctgttctgggcccacccctcaaccccacagccaggggatgcttgaggtggatccccagtgggcggaaagctgagacaagaccatccacactctcctctcagtcccaggagccagccaggcatcatgagccagctgacccgcatcaggatgcggggtctgacctagacccgagagcaggtggctcctcagagccctgtcttcagtcctcctgtgccctcctcagcccccatccctgaacggggtccatatacccaccatcgaagctgggagccattacctgctttaatagtacacagggtaacctcagcaccaggaaccccgctggtctgccctgggccccacacccttcccgaggctggccatgcctggtgtctcccattggcactgcccagctggggtgaccagagcacctttcaccatctgaccccattttcccactgatgttgttctcacacccccaccagagtgtcaaccccagagggcagggaatttttacattgcatttgttcactcctagagccccatgcctagaacactggtctggcacatagtaagtcaataaatattagttgaacgttgaatatttgaaggaagggagcaaaatttttgagatatgtcaagcaggtagacacttccatcctgaatttccaaattcatcaaaactaaagagaggtgatgaaagtaacagctaacatttattattcacttaccagaggccaggtactgtgctaatttcgttaggtcctcagaacaacccatggccccattctagagatgagggatctgaagcctggagagggtcacattcccaccgtccctggatgaggaagaggtgggggctagattcaaacctgtgctctcaccactgatccagagggaacctcaggaagacaggatggcaattgccagaacatcacccttgcaggccctgcccttaccggtcccacctgctctctgaagaagcccccagttgtgtggctttagtggtgtgatagatggtgaacagactgagctcagggcttggggtcttcaccgtctctgcagactgggcccggcacggggaaactaggcagataatacttgtggcgtgaaggaagccagtggtctcgacacaaaactcataaagtcaagttgccctggagcatttccctggatctctacgttgccactcccagaaggagacggaacctgatgtctgagggacatcatgcagttaataacaagggcattcaggtctgagcagagggtggcctactaatttttagtgaagccagcatgatgaccaggacaccaattaagagaaaatgatcctccccaggccctggctctcccattgtgtgatgtcccaaggaaggcagaaaaaggtcatttaggagaccacgctcccaaaatatcaagtcagacggggcaccccttcaggccacaaacataattccaattaaggagatggtttcctttataaggtctgggcagaggggaactggcatatcatgaattctctactgcatgcttgcttataatttattttcctgccccacttacaatattggcaaagattccatgcgattcaatcaaactttttattacatgtttgccatgtgccaggcactgtgcgggaggtggaaacatacaggatgaggcctttttaaaggcagtttggtccttgctgctcctaaggtagccaaaagctggcccacctaggattcttgcagacacaaagcaagcacttaacaagtgtttcttgggtaaatgaatatggaacggtaaatacagacttaaacctttgggctccatacaaaggcagaatgggagcagaagggtttgtaactccccacccctacagggaggatggaggtgggatggaagcccatcaagcaccaatagcccgggtccttgtagaactgaggggcttggcaccaccccagagcaattaaattggaatctctgcaagtgaggtctctgcactaacttttaaaaaaagatctcagtgaatctaatgtgcgggccagaaatgagaattgctgttctggggcacaaagaaagaagccaggaggctggggttgccctcacagctctgagacactgtgaaacagacagtcatacacacaagcaatggagcttagaagccatctagttcagtgccccatgagtctcctaagatttctggcacatggccatccagtctctgcttgattttctccaggggttggaaactcacttcctctcaatgtagccctggagagactctattttggatggctctttttcaaagatctgcctgcagtgcttggtcccagtgaaacaaatgcctctgtgaagacctgctctgactttagcatcccggtgtctatgtcaatgactttgacaagtgagcctctccctgggacacacactcattaacgtacagaacaccaggagatcagctagttccccaaccctcattctccacgatgacactgaggctgccttgcccccatcatacagcatcctggcttggagaaaactttagaacccaggtgttggggctcccggcctatgcttacaggggcaggcagcccggcccaccctgcttttcatactaacggaaatataacaaccggtccctgaattcatctgttctccaaaagcctgtatccctatcctggaagtcacctccaagactgtcacttagtcactgtttccttctccaataaaaaaatgggctcctgatgagcttttagcctcctctgcttgtggaatgtgagtgctcttggccagttagcaattacattactcttgtggtgtcaagaagtccctacagcctcctctggctttgatgaatgcgtacctgccactatgcatcaggttctgaaggtcctgacaccatacctttatctcaggagaactgtatagcatactgaaggttcctagtcccagcccccagatctgtcctggcatccagggtgtacagagttacagtgaaacacttaacctttattcaccctcctagcgcctcccagaacgctggtcaatttgccatcaccatgaggggttcacctagcaaatatttactgctccacctgccaaggatctggcccccatatttcatccagattgcaggaacccccattttcttaaatgttctagaatatttgaaacaaataattgtgctttctggatggcttgctttgaagtagttttgctttctcttagtaaaacctatctggctcccaaatgaataaaacagcaggaaatcactttgctctacagaaagctgtgggctccctgttagactgggttgctgactagaaccaaaccagcctagctgggcttgtcccaggcctgggcttccctttccccatcctgccccagccatcgctgacaagacgcacaacagattcccagattctctgcaggagctgtggtcagctaattacagggaactggctacattcatttcagatggctataacttgaaataatgttgattttcatcacctgatagccacagagaggtatgtgggttttaaagacacaaagcaaggcctacagacaactccccaccctgggtctctcagccttatcacccctccaattggccttccccctttcctccctccagcccttgcctctgtctgcaccagaagctgctgcaacactagggccccagctgaaccttccaacttcgtcagagaattccaaaatggagaaaaccactactacccacctgatgctcagaggcaaacccatttccatccccacactgggcaaaatcatcccccaaccccggcaatgtttgggccaaatgaaaatttttaagacacccagaaatcacatatggtgagaaaaacaaccgcctgcaggctccacagacatctctggaggctgttctggagtttcccagataaagaacagcctcgtccgtgtttcccagccatgcttccaggcttcccggagttgccagcattctgagggcagcatcaccttccttccatttccacacccacggccttgccaacaaacgtgagacagtgagtcctccacccaacactcgacttagctggaagaggccttctaagccatcaagtctgactccccgattctataggcaagcaaattaaggcccagagagggactctggcctacccaaggccacacaccagtaacagaaagggctgataatgccctaagccttccaagggtggggctggtgttctgccacatcctcactctgcccatccaccagcttgaacactgtctgaaagggacaggcccctgtcttagtcctctctccacccctctgcagctactcaattcaggtttggggagtgaacatttcctccatgcctcattcaaggacaaatcaggagaaacaataattacctactccaggttctctatcttcttttggcttaacaatacaaaagcttaaacataaataaagggaaatggtctggaaaaataaaaaccagttggcatggaactattggcatctcagtgcggcataagaagtagaaatgctgtttttcagaaacagcacagccgtgagtttcctaacatttggcacaggtttttcaattgtttggatgtgatggacgatgttgatagaagtggtggagaccaaacacaggctattaatagaccaaacatggcacttgtataattctttctctctctcactagctctctggcaccagactgctgccaacctgcctaccttttactttgaggtgccatgaattccagcaatggggcacgacacgagccccactgcctgcccatgtccaagcatgttcatctgagagcctggaggaaggctggaagccacacaccaacgtgggccaccagcctgtacagggcttcaaggaaactgcaagatgcaaagactccttgggtgctggtcctgcctatcacggggcatgcagtagagtctcccaagtagactatccatggtctagggggggtcagggaacctcccaattcctccatgtggttatttcctccatttctttctccaagaacatgaggcagccccatctcaaggcgggagctcattccacactaattgattcaagttagagccatttcaaggcagaaggatctccatggttcccctacaggtgttgcctctaggaactctccacagattcaaactctacaaggacttactgagtacctgttatatgacaggctctgagtctacccatccatcttcatataaactctcacttaatcctcacaggaaggaactgtccccacttgacaaatgagaaactgaggcacggaatgattatacaatttgccaagatcacacagctgaactgtgggagccagacttgaaacacacagcttctgattccaagcccaggattggtaaggaccgcagcacagtcccggctgagacctacaccctgagctcttcacggaggaggtcgcttgttcctgctccactgaagccagatttgctacttctttccccctgagctgcacttgtttccacatccccagaactcccggtcctgaccagctgtcctctacctgcatggggtcagccaccgaggaagccaggccaaagactagagctggaccgtttgacaccatcaccatctttaacatctattcaatgagactaaaaaatcctttcttccttccagggttgttgtgaggaagagcagataatgaacgtgaaaatactctcccagtcgagggttcccacgggcttaaaacagcctatgcagagggtggcgatacattcgggtttacccaggagagtccagtgtatgcctgttatctggcataattattactatgaatggtaatcattaatataataatctcaaaagtgtcccagtttagacaatgaatcatatgatcaccctatatatgtagtatttgctgccaaagggtctgagagaattggggcccccttcccgccctctgcccccacacctgccagcttccacacccactatgtgcactccattagcagacactttgccaggctcatgggcagacatcattctgctggatcaaagcaattgttagtagacagtatttttagcaaggtggtgtcacagtgcctggattaattgcaattaattatatgtcactcctttaaggtttatttcatcaattatggacaatcacggccatgtgccttgcttgctttaacccttggtgacttgaatttcttggcacagaggaggctgtaaccatggaaaaggctgaatatcagaatatatttgctactgagtcactgtgtcctggatgtcagtttagggctttcctgtttacaaagcattttcttgcacagtttcctatttgatgctgggaggtagagaggaccactcctaacccacagatggaaaaactaaggctgggaggatttaagcaattacccaaagccatacagttaggaaaccccactcttctaacacagggttgccaaaacatttccaagtcttctgtatagactgatgagtgtgaccctctggcatcagtggtcagatagccccatggccaggcatggggacaggatctgagggcgtctggaggcagacttgccagggaggagccaaaggcacctgacgcatgtctgccaggcagagcagcccttaccttgagcatttcaagtggccctaatgtcaagaaactccaagaagaatgtgtccgtgccagaaaaatatgcaaacaaggacacccagcaccttccttctttgagtgttgagcagccggaagagcagccagaaggtacctcgtacaagtgaggagatggtaggactcccacagtacccctgggtccctcttgctgttgtaataggaggagccagaggaacaccccacctgatactcgactggccttaatttgggctcctgccccccgtctattttgccctgcaccggttacagaatattagttctaaacagatctctgagctcccctagtccaaagcctcgttttacagatggagagactgagaccccaagcagggaatgccccatctccgaccccacttgccagggcagagctgagcagggacgtgggcctcccctcctgtgggttcttgctgactgtggctgggagtctcagctgggaactggggtgctgtctggagcgtttctctcacgggaaagtttgctgcgtcttttcttccatccctctttcttacctccacccttgtctcactctcctcacccacatttcatccctctcgcactattcctgttttccgggaccaggctttaagattgtcagctaaaggggctaggtctgaaggaaactcggctggagcccgagagccgccgcccctgggctccctctgagtggcccctccaggctcagggctgcttcatggcacagtcggggtcctttctgtctctctgctccatcacctcacagaggacttggcacacagtaggcactcaataaatacttgatgaatgaatgaagggatgctaccctatggcctgttcccaagaagaggagaatcgtgcaaaatcacttccctgcaggccccatcatctaggtggggaacaacacttccaattgtggggagaactccatcaacttttgtttcctcgttccactgactaaacagatacttatttgcttagaacccattgtttaagcctttttttttttttgagacagagtcttgctctgttgctgggctggagtgcagtggcacaatctcagctcactgcaatctctgcctcccagattcaagcaattcccctgcctcagcctcctgaatagctgggattacaggcgcacgccaccaccatgcccggctagttttttgtttgtttgtttgtttttcattttttgtgtttttcttttttttgcattttagtagaaacagagtttgaccatgttggccaggatggtctcgatctcctgagctcgtaatccacccgcctcggcctcccaatgtgctgggattacaggcatgagccaccgcgcccagcctatctacatgtaacagctgtgatcaaagacctaggaaaacagccaacccagccaactcctcctcctggttcctcaccctggaggagctctgggcccgagagcacagaagctaggaaggcagcagaacgagtgatgcttatgggggaaaacctggctttccacccacagctgtttcaaggcgtcctgcagaagtgggtctgggggtccctgggcaggaagagccagtctggggctcccaggcatccactgccggtgatgacacactgagctatcaaagcttgggtcagagcaaaggaaaaagctcacaccagccaaatgcacagacatctcacagatgtcacgggctaccaggtggcaaccccgaagcagctgcctcttgtcacgtgggggccaggtgggtggggattttggcccaagggggtgaactgtctcactgaagagacacagctgggcccagccagggctgtgtgccgtggggagccaggtgtgctgaggtcagcggggaggaaggcgctctcgcagggctggaagaggagaagccaggcaggcctgaattacgagggcaggagtgcacatgcttcctggaggactcacccctctccctccagctgccaccagctgctgaccacggtgggacagccagctgacaggggtcaggcggccagaggtggatggacaagtacagaacagagagtgtgggggccaaacaggaaggcggccacgggtgtggagaacgtcagggctaagacagaccttagagtctttgcatcttacaggtcaggaccctgaggcctcgacttggccaaagtcacccagctgctagatccagatctagaatttagagctagagcctagctccttcccctactcccgggctccttctgctataccatgtagattccatagcaagtaatttaagacacaaatcgtgccatcccactccttaaatcccttctgcggctccccacagcctctgggatgaaggcagaccccctaagcaaggcatgatctgacccctgcctgcctctacagccccatatctcatactcacaccataaattctagccataccgagttgctcacactccttcaaaatgcactaagctttcgtttccctcaacctttccatgtgcttgctgggccgggaacaacctccctgccttagcctttcccgttcccagtcaaccttcaggaccggctccgttctcgccactcccaccaccctaccctccagagctgcctccgcctctgcgcttcctccaccctgtcccttcaggcctcttcgggagacaattctaagtgcgttgagcatctgcttaccaggctgtgagctctttgagtgtgggaaccaagtctttgtcatctttctgtttctcccccacccccagcaccttgcacagtgcctggaatgtgagaaaaactccattaatgtttgtggaattaattatcaaattaaggagtgaatgaagcctgggcagctttgacagtaccttgtttctcccgaagctactttacctacagaagggccagtgccactcaggacatctctaaccgctgatctgccttctgctctccctccctccccatgttggagggcagtcgggtcactccatgggaaaaacagcaactgagatacaggggacccaagtaacacccccagttgtggtgctgacacaggtcgctgtgtagcgatggcaaagcagctgagatggtgactgagttcacttatccatgaaatgagtgcataaccacgtgcccaccaccatcgagtgacctgcgatctgcagacctcaggaagcagggcgcagttgtgctccctccacccccatcactgctccaaggctctgcgtacctacaccagaaggggaacagatcccatagcccaaaggagcactgagcctccaggagaccctttggaggctctggtaatgtgattttagagaccatctgtcttccaaattctgttttccctgtacaaaatacaaacaagatacgacacctgatttacatcccctaagcaccaccagctgatagggaggaaaggtccccatgcagtgagacagcagcagggacgaacgtgacctgggtttggaaaagacactacaggcaatccacaaagtggataatccacacctggctgacgaaggtttggcccaggcacagagagtgctccacagtgagtgagggttgctggactcagacccccgctcagctctcactcgacaaggctgaggacctcgcctggggcagactcggccacagagcatctgagcctttctaaagcagtcctcagccacccccaagagcccttctgggggccctggccactggccactggtggaagtgttttgaatgatggagcgcagagacaaacacagacgggacaaggtgccaggagccacataccagagctgcttctcagagctgcaaatggctctcagatgacaccccagctgctagctccttgccaggggcagggtgggcagagaggcctgcagagcaggggctaggtcacagagctggggggaggggcacagggagtcagggatttctaagactcagactgggaacctagcaggaaaggcactggaaattgtacttactccatttggtttgtctatttgtctcttgcaatttatctagtatttcctaaaaggtcactgggtggtgatttcaataatgtaaaatttgtagagatgctctaaaagaaatgtacaaatttcacaggtttacactggcttaaaagcaatatattttattaaaagtgtctattctaagtgcactttggataggatttggagactgattggttagagattcaaaaggccttgtgctattaaaagatccactgtgtttttggggtggtaaaaagaaatagaaatcaaagcatttgcaaaggtatggttggtggatggagaaaaagcggcgtgtgagatcacaaaatcctttgtcacctcacagtccccgaagcagggagctgggaaagaaagatgcttattacaagcagagggccaggtttcctgcgaaggcttccgtgtcccaaaatctcacaagccgcttctcactttcctctcaccgctcctcattaactgaagccaatccttgtcattcaaaggaaaataaacagggagcaactgcctgcagagacaaagagtcctcatatcgggacaaaacggcttctccaagcagacaccttttccctcagccccagtcagaattctctatttctttccaaacagcagagccatttccttcctgtcagcccagtgatgcacaacttcctgtcaggacagctgaggaatctggagaaatgtgtcttccctcacagcctctgctcaggtttgcagggcctcagacagtaccagggagcagagtggagagctccaaagaagcagcccctcccacgcctctgcccccaccaacgccctccccggatcccccaggtcaggccaccgaatccagactgagtgtgtgcaccgcaccctgccatcttaggcttctgtctcccagaagcctttgtgggaaccagcatttccattcccaaagccaccaggtggagaccaggggcaggcctgcccctgcggggtcaggccccgacctaatcaggaccctggggcctgtcagaaagactgaggcctgccctagggctgcagagatggtgagggcgcaagggagggtcttttccgggtaaagatgggccgctgacagcccccttaggtcagcactctggcaaacccactgtggtataaaaataaaaacctcagtcccacagactccacattaaatggagtgagaggcagggagatgaacactgaaataatcacctccatttagtaagcgctctccacgtgtctgcattcttcctttaatccccaacaaaccctgggacagtggttcccaaactttgcggcacattagtatcacccagggagctttttaaaatccccacacccaggttgcacctcagggcagtgacatcaggtcagaagctgggagccaggcatcagcatttttttaaagatccccaggggattccaaaatgaagccaagttaggggaccactgagcaaggcactgttcgtacctgttttattaataaggagattgaaactcagagaggttaagtcgcttgcctaaagccacacagcttctaagcaatagaattaggcttctggttcatgcctgttattccatcacagagcccccctcactccaaactttctgcagaaagttgttcagctctatctaccaggtattgtctccctactacatccccatccccgaatgagagcacctgcagacatctttgcttgctagcaggagtaaggatgagatgtgcgagccgaaggggctgtgcagggctggggagagcgggctgagtgtgtgcagatggcctattgggaggtcatgggatcggcaggttctgctccttcctcatctgacaatgccatttaagttctctccagagcaaagccttggcctggcctaagaggatggccaggtgtgaaggaaacgcacgcgagagtgtagccacgtgggtgagcgagggcacgacagaggtggtgaggatggcacacagcctggagagggcgagcccagggtaaggggtgaggggagacccccgggagtgctccaaaccagaaccttgggggattgacccacttcttgctgcctgtgtgacttgcagcaaatcacttccagtcactgggcctcagatcccctctttgccctgcaatggggtgggaccctatggtccagagggttctcccaccctggcctccacagtgatcatggcggcccccttcttgggtgtgagcaggtgcgggtgtgggagcagctgtggcctcatcccaggcagggtccacacacagttcaggcacccacagagccctggctctcagagctgtctggccaagacagggaggccagtgcacctattgaacatacaggccgaggagaggggccctggggcagcaccccacacttgaccttcctgagtgtcccagccatgacctcctgagcttcacatcacctggtcgcaccccaaaagtggggcagaagggggctataagcaactgggatttaaagcccctacccctcaccccagcccactgacctgcagcctccactggctgcttccctaagtgccagacagaatctggtttccctcctgtggctcattcagggaccccccccccgccaccacctcctctgtgagctttccccggccctccctgacataattaaatgctcagtgctacttctgtgcctggttccaacctctccccttgcatatattacactacactgtgctcaccatctgtttacactgctgttaccatcagggcctcaagggaagagtccggtttgactcaacagaggcagcaaagcatcacggtctgcagaaggggctttggagtccgaagacctcacttagagccccactttgccacttcctcgccatgtgaccaagcctcaacttactcatctataaaatggggcagtaagagtagtgacctcataaagttgtcatacacattacatgagatgacacgtgtaaataagtggcttagcgaaggacctgacacttataataggagctcaataaatgacagctatgagtgccttcatatctctgacacctagggcctagcacaagcccagcccatagacatagatgctgaagaagtatgttgaaataagctgaaccccagcctgtttgtagccttgacggtctgcttggcctctccaggagctagatatggtccctgcccctcccacctcccaaccagggctggctccctgcatccatccaccctgcagaacagttcccctccccagaacaagaagctgccccatccaggttctagacaaaaaagccagctgcctggctctccacagctggttcccagcgtcccttcagcttgagagcccacatccccgggcttccaggcagcacccactgagctcaagcctcaagtatcctcagtcccagcctcagccctcatcaaatattttttttaatagagatggggtctggctatgttgtcctggcctcaagcaagtctcccacctcggcctcccaaagtgcagggattacaagtgtgagccactgcgcccggcccctcatcaaatctgaagtcccaaggttagcgagtatgcagggaggctgggagagaaaagcaagaggccccttacagcagaggctgaaaccttttaaagcaacagtgagaaacgctgagagagaaaccaggcggggtaggtggggagttctctcccggagactccttctcacccttgcttcccacagaacccaagaaaaaggcacttggcaatagttacaattccagacggcacttaacgaagtccaatgcctcagcaagacagacgtttggagaaataatgacccaggggactttcagggaaggctgtctggacatggaggggcggctgtgagatttaatgaagccagttctacacaagagtccagcacagggtgcggtgcccctgcctcggtgactgccccgaaagtaggagggggggctgcacagccaggccacaaagggcagacaccaggccagcaggggaaggccaaagaacacaccctcgggaccagcaggggcttgcagaaggggactccacccaagggagcaaatgaatgtcccccgttacacacagatctgggcagacgccctcaccctcactccttcccctccccaaccctcctccagcccctccattatgcaaatcaagtgactacacagatttgcataattcatgcattattagtacgcgttcttgtcaggcttttagactttataaagcaattttgctacctttaatggagagtaagagacaaggttctagagagagattttctgtccttctttcattagacatgaaaacagtctctaaatcttaagccagggagagagtcagacagaaatgaagtgacttagagttggaaacatgaccaaacacctcgttgacacttggtgtcaaaggcctgggtgccgggcatcgcgccggtcacacatcctgtcaggcctctcaggcactcagaccatggagtagtccccagtggggcagacgttattattgggaagtcactccaggttcctgggagactcagtaacaacaaaacccccactctgggtttgtatcgcttttttatattttacaaagggctttcgctctgctatcttactcagcgcccacaataaggctatcgggttggaagggccacatttttaccctcattttagacatgaggaaactagggggccagttgcagtggctcatgcctgtaatcccagcactttgggaggctgaggcgggtggatcacctgaggtcaggagttcaagaccagcctgaccaacatagtgaaaccccgcctctactaaaaacacaaaaattagctgggcatggtggcgggcacctgtagtctcagctacttgggaagctgaggtgggaagatggcttgagcccaggaggtggaggttgcagtgaactgaaattgtgccactgccctccagcctaggcaacacagccagaccccgtctcaaaaaacaaaaaaaagagagagaaaaaaaactggggccactcacctaagatcaaatctaggctctctgtattttttccactacaccagggatggcaaaccccttgccactcttccatttcccctgcccaagatagacctcatgaatcaatcagggcactcttcccattgagctcagacaacacctcagaatccttcccaacacagccctcctggaagctggtaccaattgtttcaacttgacacccagataaaacctatttgctgttcctgcactgtatcctgccaactcctcagcatccagccaacactgtgacagtgccaccagtttctgggaagtgcctgtgggctaagcttagcctggctgctcagccccaggagccccagacagccaccatcagccagctcaccggctccaaatggaaccagatgcacctgcatttgggagcagatcagggagagtgactcctacacccccgggcccaagaggtctctgcttttctcactgcgggggccccactacccaggaccactgaggccaccttgactaatgcacacctgcttcccacacagcaggagccaaaggtgtctgcttctgcaacggacgcagcattgctgtgtggcatggggccctgcaaggggttcagtcagggaaggggccacatgaccagaccacccccgcaaacacacacacacacttccctagggccgtgccccagccagtcccaagggcacacgtccttcccttgtacacatgcggagcctcctcctctagacagatccttctgcatgggccccttccacaaccctgcaaggaaacttgtttagtaaataatagtaataaaaccctaaaagtgctcattttgatcctcacgcacatgcttgttgtccaggctagagaaatgtgaatcctgccttccccaacgccctaccagcccccaagcccatagggcagccctggctcctttcctacccttgtcaagaggccagtcccctttggaagatggcaagcagcctgccggtccaaaacagtggggtggcacagcacccacaccagccaacaccagctggcagcggctgccctggctggggggctttccttctggaacccatcagcgctggcttcctgccaggcccaagggagatgaagtacaccctcttcctgaccacgtctaaagggcctagacgatgcctctcccagccagaacccacagcagttacctccactctcttgccttacccttacttcacagtgtggcaccctccccttcctggtctcctgagccccaaatccatgctgctattgcaatcatcaatgggcttattctccaaatcatcgctggcttcttctgccaggccttgctgagttccttcctgatatttacagcccccgaggctcctttctggaggacgattaggcagcagcatactgagggggagccaggagcgtctgccccccgggaggaggagtgttttatcactgaccttgtttagaagtgccggtacacagcaataacaaaaaccagactttttgttggctttatttatttttctatatcctctacagacagtgtacccctcattgtctgcaccgggagccgattgctcccctgccccttggtaccctactgccattgggtgtctgcagccagtttccatggggctgggtcagatttcagatgaacgagtgaaagaatacacaaaattgagcagagaaagcactggctccagaagctccacttctcgctgtactccacagttggggtaatcaaggcctttggggactgccctctagggatttactgtgcttactagaggaggaatgaaggtttattcagcactctcaggccctggtgctgtgtatccatctagacctatcactatgttgtgaggtaggcattagagcggcccccaaggccaacctcccatcaccaccacccacacatggatgtgaccaaagcaggcaccggactcggagtcttcctgctagtaagcggcagagccaggagttgagccggctccgcctgacccctcacccccctccctgagccctgggctcctcccaggcctgcctccctgaatcctgtctgccccctcccctgcctgccctcacttgtccgccaagcatctaccagggcccctgtgtgccaggcacgtgctgctgctttcacatccctcatctcctggaaccctcctcactacccccccctgccctcggggagcctgcacatctctccaggccacaccgagagggaaggggcagagccagcgtgaatatcaggtcactggccccagatccagggctctttcctctctggagcctgagctgggccggcacccagctggatccctgggcagaggcccagccagccaatgggaaatgccatcacggaggaaggcaccgaggaccacggggagtcaccaatgacacaagcaaagccagaggctgggctggccatgctgacccaagaccccgctctcctgatgccacactggggttgcctgcagggaggctggtgtcttgaaaagttgactctgagatagatattatagtaagggtcatttatgtgaaccacatgattagaagtccctagatttcttctgaatatcctaggattttccccagcccctcaaagccaacacgcccaagatagaattcaccattccaactgcttcccaagtcttcaactcctttaaaggcaaggaggtcttgcctctccccacccatcaagtcaagtccatcatcatatcttgacaattaaaaacagaggccatttattgagctaagaacatgacacctgcgtaattacacctgtgtgatgcccttacagccacccgtgggccaagcatcataatgcccactttacaaacacagacactgaagttcagggagaccaggcaacttgcccaactgcacagccagtcactcccccagctccgacacgaacccgagagtagccggctccagcacgctgctgctgtcctccatacctactcctcccaaatctctgaaaacgagcaggaagagggtgtattccacctcctttgggcctggccagaagccagcgctgatgagttccagaaggaggcctccccccctccccagccagagtggctggtgccggctggtgtgggcaccgtgccatcctgttctctgggaccagaaggctgcctgatgctcgctgcttgtcattctccaagaaaaggctgggctttgagcagagcaatgtggcgagtgggccacgacagtcacttcgagcctcacacacaactcagatacccaggatggagaaaggtgaagcctgacaagctgcctgcctccccagacctccccccatatcttcccttcccactgccccgagctgggttcaagccttcattcctccttttcacaactatcgcagtaacactgcttccagcttcctctctctataacccatcctccatgctgtggctggagcacaccactgccctgctcacataccttccactgttccctgtgcctttagacaaaagtgcaaattcatcagcctagttcgtgaagcccccactactccaccagcttcacgggcagggggctccatgtccctctccagtcttctcttcccagaacttctaggaaaacctacctctccagccctccctaagaacacagggcactctccaactttgagcctctgcccctactgttgcctcggctcagaacacgcattcccttttgcctcatgaagccctaccttccttcaaaacccagctcaacccctacttcttctaagaagcctccaaacattaatatccgcggcaggcccttaacgggatgcagagcctctctaccgcacttagcacagtctgccttgcctcagagttacggcagcccgaacaccccctcagcctcatccatctctgtgtcccccaacgtccccggggccagtgcctgccacagaatgggcatcagtgaaagtttgccgagtagaatgttctcagagcttcaatatattggtacagacctttccccgacagcaaaccccatcttttcctggggctggtcctgagctcagaacaaatgtttgcttcccgaggtggccactggggaatcctggcccactcacctcaagaggattctagcgatgcctgggctggcacacttagctgtttctccccctgccaggaaatctgccactcaaccagctctgtctcccactcacacagcacagaaataatagccctgcattttcctgcaaattccatcttccccaaatggagactagctccacctgttcaaggaaacacaagcaagaagcaagatggagcaggcctgggagaacagccatgtggcctcgcaggggccaatgggggttcctgggcaatgccccccaaggctattattcagtgctggactagaaagcggattggcctgctgcctccctttgccggcacatcacagctgactaagcatgcttcccatccgggttcccactcagtccacaccacagccccattactgtgtagacaccactgccccactcaagacaagatttccaaggatgaaaagacatggagactagaaactaaggaaaaacttcactgaggcatgaggagtcaggacttgaattcaggtctgctgactcctggaccaggctgcttgatgacagaggcagcccccttgggaaagggtgagggaacgagaggacctggaagggcaggctgcagttagaaatgcaggctccattttcgcattcatcctcataacaagctggtgagaatgagtcatcgaaagcagggtttctcagcctcagtaccactgacattgtgggctgggtaattctttgttgtagggggcatccctggcctctccacattaaaggactataatatccctctcctgactgtgacaaccaaaaatgtctccaggcattgctaaaagtcccctgaggagcaaaagtgccccagttgagaagctctgatctaaaggcacagttagatcccaggtcttgtggtaagggaggggaccccccactgttctccctcactcccattctggcaggcgcttctttctcccctactcatgccactcgccaggcatccgcagcccataccagttctactgttccctctgcaccatctccctccactctaggggcagagccaggcggccccacaggcattccttatgttgggcatgtgtcaagtcaccggcctaagctccttcattaacatcacttcacaaaactcctccaaggcaggcaccatcaccccaatgaaacagataaactcaaagattaaatcactgaagtcctgcaaccaacaagggtcagggtccagctttgaaactaagtcagaaggcccatgtccagcaggcctgggctgcccaagtgaggtggccttggtctacaggtcccaagactctcaccctccaagcccgggtgccagcatcagacaccagctgggctaggagaggacctcaaaagccatacctgctgcctttccccactctcctcccagtcttaaaaagaacaggtgcagtggcttccctgtgtggtccgtgagagccctgggccctctgcaggctttggacatttggcgacatggttggtgcacatgaggctggtgattcccaacatccagtgcttaccttcccccagctgggagaccttgaggaggttattccacctctccaagctcattaatcccttcccccaacatccctgtggagttgaaagtgctagaaaattaggaatgcatatctttagcgttttgtatcatttcagtaagtttccataaaatcaggcttccaggccacactgggggagcttctgagcatttatgacacattttattcatcagcccagagcagggagatttgaccttgaaatgtggattgactcagaaagaccctagcaacttccagtgaccttcagggagtcaacacccacggtgctggaggcatggataacttagctgatttttgtttgtttgtttgtttgctttgtttgaggcagagtctcgctctgtcacccaggctggagtgcaatggcactatctcggctcaccacaacctccgccttcccgggttcaagcgattctcctgcctcagcctcccgagtagctgggactacaggcgtgcaccaccatgcccggctaatttttgtattttttgtagagacggggtttcaccatgttggccaggttggtctcaaactcctgacttcgtgatccacccgcctcggcctcccaaagtgctgggattacaggcgtgagccaccgtgcccggccaaattttttttaacgttgccagccatgcctcgaacagacctctggaaggtgagaggagccatctgttctgggtcaggagcccaggcagaagcttgccacggcctcaagcaccatcctgtgacctcttacaacccctggggcaggtgctacacgcattatatggaaattgatacacctcaaacttaacgagtccaaccacaaactccctgtcttcccccaaaaaactgcttctcccacagtcttctccattcaattaacagaaattccatccttccagttgcttgggccaaaagtctcagcctcatccttgacttcccctttctctcaccactgcctgacctgcacaccatgaccttttgtccaattcatcaggaatgccctccttttaaatagcccaagggtccagccactttttaccaactcaatgctaccacccaggtccaaaccatcaccaccctcacctgagctgtccccacagcctctcagcggggctccctgaccctggcttgaccctccctgtctgttccaaacactgcagtcagagtggtcccattaaaatgtaagtcagatcttgtcacttctctactccaagccctcctcttgctcccatctcacccagggtaaaggccacactcctcaggacggtctacaaatccctgcagagccagacccgcctcccctgtgacctcacaaccccgcccacatgatccctccactcactgaatcagcctcacaggcatcctctctgctcccaggcctgcaccgtccagtgtgaggacacgagccacgtgtgtccactgagcccctgcaacatgaccagtgcaactggattttaagtccatttcatttaaaattaaatataaaaagacactccactcttttattggaaaaattttaagtacgttttcaacaacttgagtgtgtgaatctattcttttttttttctcggacggggagtcagggtcttgctctgctgcccaggctggagtgcagaggcacacgcatggctcaccacagcctcaacagcaagctatcccccacctcaacctcccaagtagctagaaccacaggcatatgccacacacccagctaattttttttttttttttttttagagagatagagtctcactgtgttacattacccaggctggactcgaactcctggccttaagcaatccacctgcctctgcctcccaaagtgctgggattacaggtgtcagccaccatgcccagcaagtctgttcttttaattgtaaattttataaactctaaatacagatcaagtatctccaatgaaaacttaatgtctgattgagatatgctgtgtcagagacacaccagatttcaaagacttagtacaaaaaataaagtgtaaaagatctcaataattttttgtattgcttgcacattcaaataataatattctggctatgttgggttaaattaaaaatattattaacatgtataattctacttttctcttttcactatttttaatatggctactcaggaatttaaaatgacagcggtagctcccatttcgtgtccaccggacagtgctgtctacaacacaccaggcatgatcccccctcagggccttcaccttgctattcctcttcccccaggtggctggatccctcaccacttcagatcctccaatagacatcacctttttggtaaggccttccctgagcacttatttaatttatttatttatgtgtttatttttagagacagggtttcacatgtcacccaggctggagcacagtggcgtaatcacagctcactgcatcctcgaattcctgggcttacgggatcttcccaccccagccacccaagtagctaggactacaggtgcacaccaatgtactcagctttttttttttttctgtaaagatgagagtcttgccatgctgtcctggctggtctcaaactcctggcttcaagcaagcctcttgccttggcctcccaaagtgccaggataataggcgtgagctaccatgcctggccctaagcacttctttatttgttttatttgtggtttttgttttctgtttttgtttttgtttttgtttgagaccaggtctcactctattccccaggctggagtgcagtggcacgatcacagctcactacagctttgacctcctgggctcaagcgatcctcccacctcagactcccaagtagctgggaccacaggcacgcaccaccatgcccagctaattttttgttttgtttagaaggcgtctcactatatggcctaggctggtctcaaactcctgagctcaagcgatcctcctgcctcggcctctcaaagtgctagaattacaggcattagccactgcacctagctctgagcatttatttaaaatgaccactctcagccgggcatggtggctcatgcctgtaatcccagcactttgggagggcaaggcaggcagatcacttgaggtcaggggttcaagaccagcctgaccaacatgatgaaacccagtatctactaaaaatacaaaaattaactgggcatggtggtatgtgcctgcaatcccagctactcaggaggctgaggcaggagaatcacttgaatctgggaggcggaagttgcagtgagccgagatcacgccactgcactccagtctgggtgacagagtgagactccgtctcacaaaaaaaaagctgggcgcggtggcttatgcctataatcccagcatctcgggaggccaaggcaggcagatcatgaggtcaggagatcaagaccatcctggctaatatggtgaaaccccgtctctactaaaaatacaaaaaattagccaggtgttgtggcaggcacctgtggtcccagctactcgggaggctgaggcaggaggatagcgtgaacccgggaggcggagcttgcagtgagccgagattgggccactgaactccagcctgggcgacagagcaagactccatctcaaaaataataataataataaattaatttgaaaataaataaaataatatgaccactctcctctcagaagcccctgcactcccatccagagtggtcctaacaattgtgattgttattgatgatgacaatgatgaaaggaaaagagatgtctttttcctgttatctaactctggctgtaaaattagttggggccttaacagattgggatctaagacttgtcaatggagtaagaagttgtatcttggagggaagaggctcttcataacactcatcatagcacttatcaccatcgaacataatatataattaacttagatagtttactatcaggcttatctattaaaatgtaaattcgtgacagcaaagatttttctcttttgtgggttttttctactacagtcatgtgtcccataatgacatttcagtcaaggtcctgtacaattataatggagctgaaaaattcctatcacttcgtgacatcttgatgatcctgaacctgtgtcagcccaggctaacgtgtgtttgtgtctcagtttttaaccaaaaaagattttgtaagtaaaaatgcatctttttaaataaatatttctaaaatggaaaaaaacttatagagtaagaatataaagaaaatactttcgtgcaattgtataatgtgtttgtgttattacaaaagagtataaaaagcttataaagtgaaaaatttggccaagcgcagtggctcatgcctgtcatcccagcactttgagaggccaaggcgggtggatcacttgaggtcaggagtttgagactagcctagcctacatggagaaactttgtctctactaaaaatacaaaaattagccgggtgtgatggcacgtgcctataatcccaggtactcaggaggctgaggcaggagaattctttgaacctgggaggttgaagttgcagtgagccgagatcgtgccactgcactccagcctgggctacagagtgagactctgtctcaaaataaataaataaataaataaataaataaaattatagtaaggtaaggttaacttgttattgaagaaaaaaatattttaaataaatgtagttagcctaagtgaacagtgtttacaaagcctacactagtctacagtcatgtcctaggccctcacattcactctccactcactcactgactcacccacagcaacctccagtcctgcaagctccattcatggtaagtgccctatacaggtgtagtattttgtatccattgtacagtatttctactgtaccttttctatgtttagatacatacttgccattgtgttatgattgcctacagtattcaatacaggcctgggagcagtaggctacaccatacagcctcgtgtgcagaaggccatgccacctagtctgtgtaagtgcactgcatgatgctcacacaatgatgaaattgcctaatgacacatttcttagactgcgtccccgtcgttgcaacgcatgactgtatatctgtgatgcctagaacaatacactggcacataacaggcattcaataactttgtcaaatgaatgaaattatttttccgcctgggctggctactcagctggaagtttctaagtgtctagcatatggtaggtgcttgacagatgcctactgaatgtcaggctgatctgttagcagggtcattggggaaactgaggcagcttagctgagtgatcccacagagagcaaaagcaagcgccaagggtccttgagtcagacgtggtgcctcctcccgctgccacccatgctccctctccccgccctgagggaagctcccctgagcccaacagcctcaggtacctcggggaaaagtacatttcttttcctttccatagacttttattctcccagtgagaagacaaatctgtttcccctccaccagaaggcctcaagccacagctacttacattatagtaattaaatccctgctgctaggagggttcaggagacaagcaggactcgtgccaagggctggcctgcagggaggaggcagcagggagggaggctggccagaagggcctgtctctcagctgtctcctgagagtgagaaaatccccttagccacgatgtcttcacaggctttcgcttgtgggataggaagataacgccccccgcagcccaccctgccaacatgcaccatcgatgaggacccccgccagctggaatagcgtagctttcttccagttctctccgaaattccatctggtgctcacgaccttcccgcagatggccagtgcaggaaacatcccctcctcaggctccttctctcactctctagatgacaaaacagaggaccagaaactaagctgccccacacctagcctaggatgcttctcctcacctgcaactcagctggccttcacagagcgctccatgtgtgccagaaaccatgtcctctgccttacaaacagcaatatctcattaactctcatgacagccccagcggccaggttaggattcacccccatggaaactgtgaatcaaagcactgagacagcttcccaaagccacacagcctacagtaagtgacacagccagcgctgtacccaatatctgcttggcactaaagcctgttctcctaacaccaggctagatagcccatatagaagaatcagaggatggcctgggagacagatatgagggaggatggaagaagtgagggtgagatggaccttcaggaaatggggggaaggggagcagacggaggcgtgggacaccaagtctcaggcttgtgggtcaaacccaagccacatgtgtgtgcccttgtctctcgcaaagctcacatcagacctgttgttacttgttcagtgcctgcctcccccaccagcctgtgagctccatgtctatttggtgctgaacccccagaaccaaccagaacacgccaggcagtgcccttgtctcatttattcctcatgacacccattctcatgagagagagaaaacactgttaaccccattcacagacctggagactgaggctcaaagaggtcagttttctcaacaaggctgcacagccgagaagccacagagctgcggcaagaacactaggacgcatgctgttgagggctcgggtggcccctccagggcccacaggagactttcctcagccccagagcccagcacggcacctggagcttcagcaaacccctgtatctaaactgccagcatcctcctcccctcctccctctacccttaccccactccatgagcacaaaacatcccctgaggctctgggggaggctggcaggggactgagggtggcacagtaaggggtggggtgggcgggagtggagagctcaggcagggcaggagaagctttttggcttgaaagagcccagtctaggatctgatatgcaaaagcatgtctgctgcacaatgtgagggcgtcggagacactcccctgtgtgcaaatccaaactccaccacctcccagctgtgagaccctgagcaagtcacttaaactctcggagccttgggtctgtcatctgtaaaatggggagaattatatctacctcacagggttgttgtgaggacttaatgagatgaggtgtgtaaacacacatagtaggcccttaataaatattctcttctccaccgcctgtcacctcttcactcctgaataagacccggtgttgctttggagtcattcttacggaaggaaaaataagttcccatgtaatgagagcggtgccttcccccaagctgctgtggacacaggctttctttctatatgatcccgtccacccaccaggaaaccctcatgactcaactccatcctagacttgctctcagcttgcatcaatttcatttcactcttaagggatctttccatcgctggcacatagtgtgcaccccgtcaggtgtcttctgccaaaatgccctcccaccaggctcagcaccattactctcccagagcaggggaaagcatcttggcagagcttaacaccaggtccagcccagagcaggaggggctgggaaccatgggcccagctgtgagggaccttgcatgatcccaaggccactgagctctcagaagaaacaaccaaggtaaaacccaccattgcccagcatggacaagagccccctgggtgacagctctggcccacgttgaattcttcacctctccacccacaagaggaattaaaataccacctcccaaataaaggggccgctgcgcaaggccacacagccaaatagccaggatttgaatccaggtctatggggaaagcctgtgctctcttaggaagagttggtggagaacaacacatctggctggggagagacccccctggagtctgtaaggcacagattctctgcactcctgccgcctggagcagggcttgccacacagtgggtgttcaggatatgtttccagaagagggatgggagaaacaaaaagagaggaagaactaaaaccaggaattccaggattccagctatgcccctgccactaacaatgctgagtagcctcggacaagtcatgtaacttttttttttttttttttgagacaaggtgtcactatgttgcccaggctggtcttgaggtcctggactcaaccgatcctcccgcctcagcctcccaaagtgctggattacaggtgtgagccaccgcataacttctatgggccttggggtcctataaggaggaggatggtcctttccctgccttcctcacagggctgggaggcatatgcagggatcttgcccacccaggctagcacacctggctggcctacagagcttggccatctagggcaggtatggtgcccccctgaggaggcctcccctgcatcctccaccaatgccatccagctctgagccctccaaaggcggtggctcaaccctgagcaacatgcctaccccaagccctcaccttgggagaaggtaacatcacccatgcaggcagctccggccattcccatgtatgggagatttttggggagccaacatcttacccactggaagccagaaaagaaagaaaatagctaaactccaattcgttaaaatcagaaatctcaaaaggggttttgctctgcaaaaatcgctgctagtggaagcttgcgaggaggcaggctgatgccaactcaggcaaaggggctaggaggagccaccacttgctggcagcccaggagcacccacagccaggctggccacttgaccaaccactagcaagtgtcatcctccccaggttagtggatgtcagtctccccacatccattacaaacggggacactgaggctcggagagtttgaggcacagagcttaaggaaaaccaacggtggcagatggaccagaatgagcaagggcagcctctccctgcctccctgcagggccccctcagctcaaagccactgacaggtcagcaaggttcaatggctcaagccaggcaacaggtcatctgcttcctcctccctacctactgggtaacctgggcagggcacccacctttataggtctctccatctataacctgaagcaaaacaccaaacaactgtccttgcagatgtcgcgtggcaggcctggtatcagcaagctctaaggagtaggtgccagctcagtccctgcaaggagtgtcctttaagctgactttcctgttaatttgacactgagcag

SEQ ID NO: 901 - DNA, 172814 bp, Homo sapiens
tttggttttagtcagttctcttcttgtttttatttaatgccataatattatattagcatatgccgtaacatttaaaaatgcccattctctccagcttcagttcaagcaggagtggggaaggccatagactaagcccaccttcaaggtcacacttccatattttgcacagagaagaaaatgcagtctcccatccagatcctcagacccacacaccagcccaccactctcattccagatgccctaagcctgggtctggacacatgtggtcaatacacatcctggatcttacaaatccaatggtggccagcagtagaactgaagcctgtaagttttcattcactcctaaagtgtgctgagaaatcctagcctgttttttccatttaattcctgtagatgagtcatttgctcctcagttttctatggcccaattttcccattggaataatgggaataatatgtcatccaccttacagggtgatgactaatatattggcatttgagatccttagatgaaaggtattactgtgtataagtataaagtactattatttagtaatcactgagttggtaaatgtattcattcatatggagtttttggaggaagagctttaaggaatgacagcagtagaaatgcagctagatatatttttgaaaacattttttaggtctaccaacttagaaaaagtcccagatattacatactccttctaaagcacctaatttgcatttttattattattattatttacctagaactacagaaaaatttatgggaaggaaagtaagggtacagggttttcaacttggggaaattcatttcccatcccctggctgccaagccttcctactcacaattccacaaatgtgcctgcagctgtgaggacagctggagagatctgttgtctttctggtcacctctgacattttgcagtgtctcttctgattgacactgtatacagggcatgacctctctgacttggccctgcctattatgaaagtgtcaccatgggggcagggagctagagagatttagttggtttaaagaagtataatgtgtccttgagctttgagcacagcaatggaaacctggcgactcttcctggagctctagggacttctaaccagagcaagttggttcattacaagctgtcacaccacagaaagagaagacctttggctaaggtagagaaaggctgactcatacaggcagttgtataactgtagacaggcagggcccatggagctgtggagagttcactgggactcctctgccttctaagacacaggttcccacctgcttcagggagagagacttcccactagtccaccttctgtgtgtgttaccaaaaggaagccatatttggagctggtctaagctccagcccctgcaatttcatttgcctttccttagtaaggaacacagtaacaacgcgaacaaaaccacacagagcatgtgaagaccgggcccttctgatgctgatgtgtggagaaaactgggcactagactgaacaaatttttagctattgccttatgggaaccacagaaatggattgaaataaaacttacaaaatcactttaaccactcttatttatgcattaccaccaagggaaaacaaagtcactgaaacagaaaaatgttttccaaaggaaaaatgtttcctctttggtgacctgagaaagtttaccgtaactccattcaaaaccttcaggcacttgacttttttttttttttttaatatcctttacctttttaataaaaagtaaaaaacaaacaaaaaatacatcaatgttccgaatagaacctctctatgtaaaggtctcactaaacaaataaacataggaccagacaaaagaaatggagctgtgaatagcaatatgatatattatgaagcatttatatatgtatgtatatattatatatgaatgtgcgggtatatgtgtgtgcacctatgtatgtataaatctgtaaatatttgcctacatacacgtcacacacacacatacatatttatactgacctctttagattgaagtccaaggcactttttacaatgaacaggttaaagccattaatttagaacataactgtttctgggtacatatcgagttatggcgccaatatcagaattcacgtctttccttgcccaccttggagtgtttcttgttggtgcaatgagtaagagaattggctttcaaggagattagcaatgtttctagatggttaaactaacttctcttgctattttcctctaggggaggggagttcttactggtgagatgctgagttcctcaagggaagaacacaaggatcgagaaacacaacaatttctgtactatgctaagcagagactcctgtagccttccagaggacctgccctgaggttccacctgatattctgatggctttgctagtctggtctaaaaaaaaaaagactaaaacttaaaaatgggggctttgaggtggctcaaggatatggagtgctatttaggtaagaccggaaaaagactatctcttattgactttattatgtttgatgtagaccatccaagttatataacctcaagtggaatttaaagatgcatttttttaatccttatgatcattcaggaccttcacatcttcaaataattctgtaaatgagactcaaggaagagatagcttcattctctaattattaacgaggttagttatcactacggtgaggtgaggccagtgcttatcaatatttctggtgcatacaggtcacctggggatttgttaaaaggccaattctgatgaagaaggtttgatgtggggcctgagattctgcatttctaacaagcttacagatgatgctaacgctgctggtctgtggaccacactttgagtagcaagggttagcatatagccatggacttgaattactgtcaagaggtctgctttccccaaatgatgaatttgcatttgtttccttgattctagatggaatacaactttgaggggaaaggtcagaatatatttgctctttataaatgtaagtcttggtctgagcagtgttagaaggaaaaaccaaaagaaaaaagcacttactgggccaggcacagtggctcactttgggaggcccaggcaggtggatcacgaggtcaggagatcgagaccatcctggttaacatgatgaaaccctgtctctactaaaaatacaaaaaaattagctggtcgtggtggcacgcacctgtaatcccagctactcgggaggctgaggcaggagaattgcatgaacccaggaggcagagcttgcagtgagctgagatggcgccactgcactccagcctgggcgacagagtgagactccatctcaaaataataataataataattttaaaaaagaaaaaatcatttagtagcaaaaaaaagtgaagaaataaatcaattaccaccaatacattcatcagtcaattgtaaaattgaaaataagccaatttccattatccggtgagtaagtaacctgataaaaacaagtgccctggagttcagatggctttagtggagctcggcctaacatataactgaggagtaatacaggcactgagagaatttagctccataacaagaaaacttgtgtacaagttagggctcagctacacaaacagactgaaaacgggcatttagacatttctctttcaaacagcatgaatacctaatgtcagtgagccccatgacttatatacctttaagctcatataaattgaaatttgaaggattccagccttttcccaggagaaaacttgttgttttgcactatctgtaaatctatgtgaattttcagggcttgggaagggaagagacacataggctcagttaatctgccccgatgcaacctggtttgcacctgtacaatattgcaccaaagcaacaacagcaagtgagggtcccaggtgagaagaggctcactgattctagaaaatctttattctgtaaccgaacacatcctgttttcatctagaagtagtgccttagccatatgaaggagggaactgagaacttctacatgtatgtctcagctgctctgtagagaaagaggggtgtagattccatgagttgcttaattttgctataaaggacaatatctcaacgggaaccctttatttcctcccagctagaggaagctagcagaaaaggcagcccggctctttgctggctctggctgttcatgtcctgccggctcctcccatcactcccttaggagctgggctccatgtccttgataaacatgtgggaaccttgctccctcaagggtattgccaatttagaaaagcacatctgcacactggactcttgttgggccttgtgtagtttggaaagccgaccccggtttcacgtacatggagaaactcagaatgcctaggattttgagtattttaagttacaggaaaacaggactctttcttatgtccaattctgacattgtcaaaggaaaactggttggctaggtttgagacttatataatttatgtaatgaggcctttgaatttatatagaaagagcctgaacttttattaaactggctttgcagagctactaaaggagtgatggcttttaaaatctcttctgaaatggcttgatagaatttagggtagaattattcctctactcttggaataatgttcttttgtctctaatacccaggccttggagaattagaatatggcagttcagtaggctgtggtaggaggaccctttttctgggtgcccggcaatcactaacagtgatgtgtactcagaaacagtcattgggagagcaggctgacagtggacctgctaaacactagtttgatacaaaatgttaattgaaagttacaatatattttataatatatcaatatatttcatatttaaaataaactgttatgctttctcctatcattaaaaaatagcaagcagtacagaggcaagatgcaaattcatattaaagctcatctgattctgaatataaacacttcagtttctgagcttgccatgaaaatgtttcctccattaacatcctgtcattctcttgttgttctcgtggccagtgcagaatggagagtctgggaccaaaattgagttgttgcgccattaaaaaacgtatctgatgaaggtggatcagtcctggttgagattcaaaaactgagacaacatgacacagctagagaatgttgtttattccttgtccttcttgagtgaagctggacgttggctgcttcgatctgattcagatatatatatatatatatatatatatatatatatatatatatatatatgtactttttctttttggctataaatgtcaacatctctttgggatcctaactgcaggttggagttgaattttgtgcttttcctccaccagcttggttggtcacgatgtgtctcttttgcttgtttcaacacatagcccaggcccaagattacagcttccaggatacatttttcaggtgtgtaaacaactgtcacagggcacttggcacctagatttggaggtcatatgttgaagatttgacaatggttttgttcagagggaactccagttcacgtttgggtgtttccagtaatggcgtaagacaaaaagatcacagttatatttttttctatctgtatatatgtatataccattgcactgagtactttttaataagctgtggtctgtttcaataaaaatctacatattactcgtctaacaggagtttaacattaatttctattcatgcagcctggcacaagctttctactaccacaagcagacagttactattgcgatccctgtaaactcctttctcagtggtgttaatgatcccatttccctaatgtttattttggcggcagtagagaaggaaaggatactgtctggggcgtcatcaagcccaccgactgcaaggggagagaaggggttgttcgtgcctactgggaagtcaccagatagctgtctaaggtactgaaatcaaaccctgcagagtcaatagggatccttcatctgcttctagcaactcttaggggaagaagaatgaatgtagaaaactggggacatattttaggatttaaaaacagtaacttcaaaagagtagtaacctactggtagtgcaatgacttcacagtatctcagttgtggtactgtgatgggagcaacaccgtttgtcctgggatgaaacattgattcttaatttggagtgtactgtttgttgagttgcactctggaggaggaggaaggttctggaactacgtgctaatcccatatttctccctgctgattttaccactatttaatgtgcactaattactttttggtaactactgactgcattcaaacgtaacatcaaggtgtgatctagatacagtcagtctgggctgctgttgatgacaaaggtgatttcatttgttctctattgaaaacattgtacttaagaatattaattattctcttcattttaagtacagagaaattgatgtattaggtgcttatatgaattggccaaagatgtggatccagtcttaagatttttatttattctgattttgtatgactaggtttcttcttttccatgattgtttattcacaaggaaattataaaaatttaagggggaaatcccccactatattaaaatcattacttcttcaatgctcttccttcttggcttttaataataaaaatagcttgtacatgctcagcgcttggaatttacttttgcgtacattttctatgtctcctaattcacaagattgttgttctaccactggcccctgctgaggtcggtcagtggtgacttggggccttccccccttgttcttttggattgtattaagcacttctagagacatgatgtcatgaagttacgtattaggaagatggcaagagcagttcatagacactttatgacaatttattgatgatgatcatatatatgtggcctttgatccaaaggtgaagacttttatttggacttcaatctaaggaggagtgagcccctagtctggtgtaatttaccaactaatgctatgtcctgaaattccactgagattagtggtcttaaagtatcacagtacatccctgactttacagtacatgaagctttaatatggcttaagcaatggcaggggtgggggtggttctgtatttctaattcaagtgtctagatattttaggaatattagagtgattttacctgtcactgagttgtcagaaagattatagtaggggatctgccattgggtcagtcctctaggagtgggcagatcttgatcagtacagtattggagtgaggttacataattaatagtttttacatatagccgattttttttttttttttgagacggagtcttgctcggtcacccaagctggagtgcaatggcacgatcttggctcactgcaacctccacttccggggttcaagtgattctcctgccgcagcctcccaagtagctgggactacaggtgtccaccaccaaacccagctaatttttgtatttttagtagagatggggttttgccatgttggccaggctggtcttgaactcctgacctcaggtgatcctctcgccttgcccaaagtcctgggattacaggcatgagccaccgcacctggctatatataccagattcttgagcagataattaaacctcctccaccacaaaacttgaaaataaggtacaagaaggcatgacatgagaatccacctgccccttttcccatctgactgtgatgctgaggtgtggtggaattagccaaaagatgtaggaagaaaacttgggtgagctacacccagaataattaatacttaagtcatcaagggttgattgtacttgcaggagaacgggtaactttcccacataaagctgaaatgctagtacagagaaatagccttccatttgctattacaggatcaatgtgcaggtttgatcactttttttttgaagcattttcttttgccaagaataaaaatcatgtatagctattgcactaccaataggtcaattcatgctacaaatgtccatgtgtttctaggatgccagtggctactgctaccagaaataactccagtcactcccttgactagtgttgctagtttggtctttagggtttacctaagtgagagcatcaatgatgggttaaagtcacagaccacaatgaataaatcacagtctgtgcacacttttggccaggaagagtggcagtggaatcttgcatgtcatttggttgaaattaagactaaatctctatatgtgcacacacccacactcacacccacacgcacacatatcacagggttatagcagaatgaaaacggtgggtaggaatcaccagttgaaggctgtaggtttaaatgatcaggattggcacactcagatcagcccaccagtggtcttcactttgtgaaatggaactaatgccacaaggaaactgcatggttacttcatctgtttacacatctgcttatatgttcagctgaactgtcactgaaaacaggagcaccattcttgggacatgaaacaaggaggaggggaaacattcagataatcaacagttaatagaacaagtaaaaaaataagccaacagcaggtgcggcatctctggtatgcaaaacaactaatgaaagtgttcaaaggaattatcaaggcaggccattaagactataaaccatcaaaagagcagcagcaatagcaagagagaaagaagagggttagcaagagactagatcttcctgaaaaagtggccttggctctacaattgtctaccttgtgctgtccttagaagaacaggcccagtgctacagaataaaaatctccatgccaagccactgccttcagaatggtgatgatgtcttcttacaaaggtaaacccaagatgacaaccacaagcaaaaaaatcacccttttgttttaccatcaacagatgaaatagtccatacagtgccattcaatttcccacaggcagaaaccaaagacctcagaatgagaaagtcatggttttcacgtcacaaatgttacgtgtggtcagattatggagcaatgaaaacatttttctgcgccgctcattacactaaatcttgatgtttctgaagtctcttggagtttgagatgtattggaatagtttttcgcaccaagattaacatggcacagtaggaacaggctactgacaaatccatgtccacttaccttacccacaaggttccctaagggttcccttcattctcacaatatttcattttgagatgacttaaggtcaggtagaagggaccacataggccactcttcatcacttctcctcctagctcagaggctcacaattgaggcacttggcccttttgcactactaacatctggggctggaaacctgttgctggataaatacagctcagcaaatccccaaccatatttctattcactaaggtgttattggattgctcctgtttgtgcatgtctgcacacacatgcacaatttcttgtcctctccctccacacttacagacatacacctggtcatgtggaccatcgaaacacaacttgtttggatggaagaagaaaactctgcagatgctgttatttttagaagcctgcttatccctcctgaatgccaacaattttggcttggcatccatttcaaatcaagcaaggtgcatatccaggacaaagcaatgtgcattatgtctgaagggatccacatcttcagtgaaactcagaatgtggccagaactagctaactacctgaactgaaagcaccccatgttcagattcagaccaactcaaaacacatgtaaggggtgcctattgtatgcagggtaaggtgtcaagtccctttttatttggattaagctcaaataagaaaggacctgaagcgaacgtgggatgtgtatgtgtgtacatgtacacgtttgcaaacacacaggtttatgtgggtattaatatcgagtggaaaatctggctttttatttgtctgtgtctttttttttttttttcagtctgattcgagtatatctgttttggcaagttgtgggcagctctcttttacttttgtcacccagaggcttccgtagacaaaaggaaaggagagaggtgtgttcaaagacccccatggcgaagagcccatcccccaagcctgacacaaccctccctcccagcggacccctcttctggactggcttcgctgttggctacttcagtgcatctgacccccaccccccgcgtgaagacctgagattgagcgtggatttctgttctccaccaactctgcagcaagggccctgccagaggcgtcgcttcctgtcatctcctcttcccgctcccaagtagaggcacctaaacagagattagatttctggtttcaaggcatgtcggaccaagcacgctgaatgaacatgagttagttaattagctcggtctctcttctttccgttccctggtctgaatgtttcttgatggcaaagcgaccaggagagagttgatttgcatcttaagacctatgggtaatgcttctggagtggggagatttatttagcaactgcttgaacttgtgtacggggtcgggaaggaggtggagctgaccccaatggggctatcggagattggggtgtgggtggtgcccactgccacgctgacaccccgggcctcgatgatggcagacaggagctgctgctgctgctggcgcagggtgtcggcgatgagcagcggcagggagttgaagctggcggtgagatgctccagcttcgactccaggctgccaatctgcttctccaggtcttcgctccggtcattgagttctgtgattaagtcatacatgacattctgcatctgtgtggagagagagaggcgagagacagggagatgacaggtcatcacagaggaatctgcaatgggagaaatgaaacgccctccacagtatgacaggagccacttccacaccagctgatctggtcaaggaaggatacaggcttctttcctggggatggggatgctgaagtgtgcacatttttgttttcttattacaaaagtaatgagtattaatgacagcattttattagaaaatatgcaccaaggggaaaaaaatggcccttttttttttcttaaataaagtgagtctctaaactgtctcatgttctcacagggccacaacctctcagctcacatggctgctggcatctaatgattccagagaagacgctggtggggaatggacagtgcagtgggtgtataattagtaggccagggctcaagtacacatctgcagctcactaacagtgtgccctctgccaggcgcctggcctctctcaatctcggttgccttataaaattggagttaataataactgtacacagttaggagttattgcacatctcccaacctctattttaacccagcagacaggatgtaaagtgaattaactctcaggcacagtgcttagccaaaggaggctgccttgctgaggtgtggcccttcgcctgcctgatccacaatgcctcagggtgggacatccctgaagggccactctgaagggctgaggtctttgttgactgtatcacagttcaaaccctcccactgaccaatcctgcttccctcactccttggcaggggtcctgagggtgctcccctgagagctccccagtacccctcctgcactcagcactgactccccgtgttccaggggtgccggccgattaccagtgctccttccccaacatcctgtggcccccttgttggtctgcagagtcccagtctatgcaacagatatttttctcccagcaaattagcaaatgccatcttggctgtgtacatcagacttgggaacaagattcacaagcatcttcagcctcccacgtgtcagggagtgaggctcctggggcggcaatgcagagggccaggccggtggttgcttggtcatccctgaggtactgtggctctttgggtttctgatgatctgccagtgacaccccgatcctatttcacgtgaaatttcaggttactctaggaagatatggacatgatttatgccccagggaccaaagcagcagcaagtaaggtgagaggaaaaaagaagagtaaaagaagatgtgagaagccagagaagaatgaaggggagcaggggcacaaaatgcagtgaggcctccccagcagactacaggccccatgaggaaattcactggggcagcataaggaaaggtcacaaggtggcatggagatggccccgctcccatgagctctgctgttgccagagcaggacaccgtgtcgtggatgcccttggaggacagggtgactttagaagtgaaagtactccctttattaatcaacatgacagaacctcctcgaggcaaacattcttcccggaatgtgcaaaatcacccatttcatttgaccgcaggggcaccctgatgagctctggactcagagtccaggcccctgggttgtggcccccacgctggtgctcaccaactgcctgaccgtgggatggtcactttgttcccttggatcttggtttcctcatctatattgataatcagaactaccaattgcaaaacctttatagtttacaaagcattttcacagatatcatcttattcgatcacctgagcctccgatggtaggaattatttttatatttcaattgaagtaattgaagcaatcggggaaagactccaagccctcccagctctgccagcctataggacagcaattcaatacagacgtaatatgtggaggccacatgccatattcttaatttagagaggaccaaagggcaggagtgggaaggcgctgacttgggaggctacagcacaaagacagaaaagagagagaacacagcgttattgtctccccctgttccgttgcttggtgacaggatgccagggggaatatggaccagtgtgaagtgtgctaagctgctgccaggaccttgggtgagtctcctgggaggaaaagataaagactgggcgaatgtcagagttcatctcctccccagatctccccacgggggttctgcagatttttcccttaaccctttcctgcacactctttctttccaggtaacttgctcctgggttatttacggcttagttcccccacccaattcacaggagtgtctttccagttcactgaggggttcgcttcacccggtctgctccgtgggccccatctctccaagaggccgtgggtggcactgcagaaatgcaggcttgaaagtttggtttgcccaaaagtgggcgaaggatatgaacagacacttctcaaaagaagacatttatgcagccaaaaaacacatgaaaaaatgctcatgatcactggccatcagagaaatgcaaatcaaaaccacaatgagataccatctcataccagttagaatggcaatcattaaaaagtcaggaaacaacaggtgctggagaggatgtggagaaataggaacacttttacactgttggtgggactgtaaactagttcaaccattgtggaagtcagtgtggagattcctcagggatctagaactagaaacaccatttgacccagccatcccattactgggtatatacccagaggattataaatcatgctgctgtaaagacacatgcacacgtatgtttattgtggcactattcacaatagcaaagacttggaaccaacccaaatgtctgacaatgatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacaccgcatgttctcactcataggtgggaattgaacaatgagaacacatggacacaggaaggggaacatcacactccagggactgttgtggggtggggggaggggggagggatagcattaggagatatacctaatgttaaatgacgagttaatgggtgcagcacaccaacatggcacatgtatacatatgtaacaaacctgcacattgtgcacatgtaccctaaaacttaaagtgtaataataataaaactaaaaaaaaaaaaaagaaagtttggtttgcctcatgtccccagggaacatcagtcacagcatgtcctgcaaggtgagaggagaaacaggaaatactgctactcatggaagaaacatcctggggcagtttgttgggctattcctgaagctcacaggtgggcccctagccctgtttgctccatatgaccctcttcctggccaatgctgattggtcccagggtggatacgtggcccaaattggccaatcatttcttctattctgagaatttagaattaagactagtagggggccaattagtctttacctgtggctaaaactattatatgtactctctgaattggagcctgttacagtctgtcgcggggacaggaggcagagagggagagaaagagaggaagagagagggagaggaagagagagacagggaaagggagaggaagagagagacagggaaagggagaggaagagagagacagggagacggagaggaagagagacagggagacggagaggaagagagagacagggaaagggagaggaagagagagacagggagagggagagagaactgaagcagtcacttaaacagaaggacagagaagaaatggtgagagacctcctggttgtgggggcttcccaggtctagttcgagtcagttccttcctgcagtctggccacatgtctcctttgaggttttgcctggaatgagactcccttatatccttagaatagatttctccatttttaaacctagtcccagcgggtttctgatattaaaaccaacacacccaaaaacctgagggagttctctcctgcatgcccacgttccactcccaccccaggctcctaggaaccaccctgcactccacgtgaacgccctcctccaaaggcacgcgggcctggaggcttctccccaaatgtgccaagccacttactccccgattgaagtcctcacaggtttagaaggccctttctttggttcaatccctttattaaacaaggcacctgcacgtggcccgacaactagtgatttctctgattgcactcttttcaaagggtgcttaatgtgcctgagggagtttctcttgcttacccagggaatgtgttccattatgataattgacatctgctggaatgttctgccagcctggccctgggctgtacacttaatatacaattcctatcaagaggcaatgaggagagggggctgaggagggggaggccctttcttcagtggcaccgactctcagctctgccagcagtgtggccttcggctccctcacctgggtgatttgcaagaggagtttccttacagtatttatggcagctcagggccagaaacagagtggcagagtgatggcgagccttacaccctagggctctcaaaagagggctctctttttgggtatcttcatgttccttgtaggctatctgcctcttgagaagtaaagaaatgcacccccccacacacaccactgccgccaatttgaggccagcaaaactagttggttaaggactggaggatgtacaaaaatgaacttccaagtattacagcaaaccggtgtgacctgggcagttaccatggccatcgttaccgtctggtccttgctagcatgcttcacagccgtgcaaactcaagcccaacctcaggagtccctcaatgtgcagctcataaaatgacacggaaaaggtttagtcagctcattaatttcacgcagagacacacctgagcgatttcacttaagaaacaaacaccaagtttcaaaagcccacaagacataccggtagattgcaaatgaaacaaacttgagcctaggtatttttgaaccaagcagaaatttttctttgcttgcctggtcccgcgctgtccagtgcgaacccagccaggactcacaggtgagcctgagaagactcagtgtctgcgtgttctaggggatgtctccagacactgccactcaccttggaaaggtccaccagagtgttggcttggtcactcagcttcctctgttccatcttgacgctcctcaacctgtggggaagaatggtaacaggcaagcccttcaagtccatgcaaaggtttagccccaccagcagatcctccagccctaccactgcctctgattttggaacccagcatggggaccgtgaacctggggaacaactgaggcttttactttccaggggcttgtcacatccccccagaaagcaaactcttgtctccacgcatgctcaccttcagtcactggtttcttgctattcccagatcatttccctgcctctatgcctgggctgcaccttccatgttgagtgccttattctcaacttttcagggattccccaaacctctccatcagaatgaatgttttcatcctttgcttttccactatacttttaaaaactcctccatcacagaaagcatcagccacggtttgttttgatttgagttgcaatgcatggtgtgtgtgatgtgtggtgtgtgcggggtgtgtgtgtgtgtggtgtttgtgtgtggtgtgtatggtgtgtgtgatgtgtggtgtgtgcggggtgtgtgtgtgtgtggtgtttgtgtgtggtgtttgtgtgtggtgtgtatggtgtgtgtgatgtggtgtgtgtgggttgtgtgtgtggtgtttgtgtgtggtatgtatggtgtgtgtgatgtgtggtgtgtggtgtgtgtgtggtgtgtgtgtcgtatgtggtgtgcatggtgtgtgtggggtgtgtgcggtgtgtatggtgtgtgtgatgtgtggtatgtggtgtgtgtggtgtgtggtgtgtatggtgtgtgtgtggtttgtgtgaggtgtgtgtgtgtggtgtttgtgtgtggtgtgtatggtgtgtgtatggtttgtgtgaggtgtgtgtggggtgtgtgtgtgtggtgtttgtgtgtggtgtgtgggatgtgtggtgtgtggggggtgtgtgtgtggtgtttgtgtgtggtgtgtatggtgtgtgtgtggtttgtgtgaggtgtgtgtggggtgtgtgtgtgtggtgtttgtgtgtggtgtgtgtggggtgtgtgtgtgtggtgtgtgtgtggtgtgtgtgtgtggtgtgtatggtgtgtgtgatgtgtggtgtgtggtgtgtgtgtgtgtgtgtgtgtgtgtgtgtgtgtgtagaatgtgaaagctcttagaggttcttactctagtttttaccttccatagcagcctgcccaattcctggcatgtggctggtgcagtcagtgagtgatcagacccagttcaccactccacttgttgagtggaacagaatggatttcttctgtgctactgacagagttgtaggagtcccgccactcccagtctggtcatctgatggctgaaccgctctggcatactcactggtggatagcttggaggaacttcctctggtgtttcctcactttggcatggtcaatcttctttagcagctttgtgtgtttatagattaaccatgtttcccgaaggacattggctgcagcattcttgatctaaggaagaataaataaagtaggctgctatcaggttcattttcttaggttcatttttgtggttgctactgtagtctacctcataaggaaacgattttgcaatgatctattttcttaaccaaaatcacggaactcctagaaaagatgattaaggccgggcacggtggctcccgcctgtaatctcagaactttgggaggccgaggcgggtggatcacctgaggtcaggagttcgagaccagcctggacaacatggtgaaacccgtctctacaaaaaatacaaacttagccaggtatggtggcacatgcctgtagtaccagctactttggagactgaggcaagagaatcgcttgaacctgggaggcagaggttgctgtgagctgagatcacgccatactccagccttggcaacaagagtgaaactccatctcaaaaaaaaaaaaaaaaaggaaaaaaaaaggtgattaaaattcatctgttcttaatcttgtgttggacactgcagaccagagcttgaagttggagggtctttctttctttctttctctttctttcttcctttctttctttctttttctttctttctctctttctttctccttccttccttccttctttctttcttccttcttgattatttcaatactatctcttgactgctgttgctgatgctatatttagacaggctgcatgagcgagaccttgagtcccggggtccccttggaaaatagctagcgatataccattgctgcccttacatgcagacttccgagctttgcctgagattgccacttcgtgtatacggtacattgcttgggttcagagagtaaacagatttcctatcagctggagattttaaaagacttctttgagaaaatgtctttcccactgattggaactataggtaccaacgagcccattgtctcctttcccaaatggccaaaaacatttgcactgcaattgtacatgtaaatgtaattggcacaaaaaagaaataatttcagagcaatgtctgaaaatcagtgaagatatttaggtgtgaaaccagagcttcctcttccccagggctggctccttcactgtgcactgcaatcacacgtttcaacatatgacgctgtcatccattgacatggaaaccactgatatcaccaggctcatgactgagctgagacatatcaatggcatccagatggcaggggacaaagttttaatccaaacacagacatcttcagcaattagtaacaagagcaacagaaaacattccttattaagcacatgctaagcagatttttgattaaccatccccatttctgtcagccatgcagactggcatgtgtccacaggcctggggcctggaaataagtaggccagcctaatagaaatcaggttactagccagaaaggattttaataaaattagagaatatagacctgcttcttcagactgacatcaacagatgggatgttgttaaaatactgagatgtgtgggaagcctaggaaacattgttttgcaggctgataacttttgtgtgtgtatgttttaaaaatttattactaaggctggattatatttttcattggcgctgaagtgatgtttttaaaagaacagctaagtcttctcagaaatgtctaagggacataaatattgctttttaaaaattcagtaaagatctgctgtgaaaatagttttaaatgacttaactgcccacctctagtactttcttgcctgaaaggaagcaggttgtggtggaaagttggaaacggtggatgtccaggagaggacactgtggtctctgggcttctgctcagggaactagagtgaacagcagcctcctggcaaaaaaggcggcacggaagggaagccttgctctctgcagagcacacatttaatactactgccctcctcttgcagggagaggaggcaattggatgtgtcatttcttcagtttccctacgcacttagcctcttaggaaagcctcaaggaaactggaaagtctgcaggtgaatccctgctctgtcaattattaagcagtttaggagcaaatgcttcattatctgtaagatgggaaaaataaagagggctgctatgaggcagtgatgatggtgctgggggcaacacttaacatctaccaggtgcagccacaggtctgagtacttcatatgtctaagctcctttaatcctcaccacaaccccatcagggaggtgctaacattatccacattttacagatgaagaaaccaagacacagaccaagactagacaattattaatggcaaactgagtcagtgtgggtgtgaatgctacataaaatgtaaagtaccatacagatattagttaatattatctagctcaaacccctcattgaacatacgaggaaaccacttcagagatgggatgtgagagccagaatcacacagctagctaatggcaaagtcaaaacaagagccacgtccaggaagagcagaaggttttcatgtggactgaaggaaagacaaacaaaatcatttcctgttttccaggatcaaggaactggaaagagcactggattttttttttttttaaatcatcatggccctcacttagcaatgtgacagaacacggagtccaggtcctgcacttaacgtcagcccaaatgtaagatactgaagtcacagcacggcccgggtagctgagagaggcagtcacatcatctttatgagtttggagggaggcctccgtgcattcgggaaagtgatgttaactgccagcccttgcactgactctgaaattaattaccagcaaacagcctggcacaaagctaagtagatcaatatctgcgagagaaaaagaaataggcttttaactgcactgtgctttcccaggtggacagtaaatgctattgtggccagggtctccctccagttcacctggctgattgatctaagcattgttggggtcgggagcacatgaggtcatgtgcccttcctcagatttgccgagcctccaaagggctccatgcacccttccttgagggaggcttgggtaccacctgacctctcctggtgggcagaggcaccagggccaaaagatgctctcagggtgcagcagtgcgagagggcagggcttaagatgaaagcagcaagccagaaagagtggctcaaggttggccacaatcggatgggtttggggatggttaggagaggaccctttgtgaatggaagtccagctgtcctgcctccaaaacccataaacaaattggctgattgttttctgcaagcccaaaaactctctaccaaaaaattgctttcactctgattggggccagacaatgggctctatgatctactttaggaaaggctctaagattaatgggcctgggcaagaaagtggtccaatgaagaccttgcaaattatggtgacagctaacatatactgagtgcttactacgtgccaggctttgtgctaagcacatatgtctgcactggttcattaaccctcagaaaaacttgataaatagacgtgatcatcagctccaccttggacccactgctgaactctctgagactctctttgttcatacatttgaggaacaattaatgagcacctatgatgggccagacattgttgtagcaagtgacggtaccacagtgaacaaatcaataacattgctgcgcttacggaacttacaatcctgcggagaagacggtatgcagtttgtatgatagcatcaggtaacaagcgcttaaaaaaccacaacaacaaagcagggtccagggctagagagtgatgcaagtactacctgcatctgtgaaatgggattactgtgttgattaaatgagaatatacttaaaacattagcacagatcctggccatatgcctcaatacatggtacctttgttaatattctctccttccaataaatgtcagcttccttccctctaacttccccagccagcaagaaaacatacaacagaacacacacctcttccttgagctcttggccgcagcatcccatgtcaatgacttgctctggccacctctctgcccaggtaacctgctacttgctattacagaggggctgtcggttgcggcaagaatgcttggggcaggagtacaagggggatgaaaggagcacctttcttgggcaccctaagcctccagcagccccaggagccctgggaaattccaggggtcccattagcagagccccccagagaagaaatcactagcatgcccattatgctgccaggaacccttgccagggaagtattctacttggaggttggagacggggaaagggaggcctggccggtgggtgtgatttaaatacacacatcttggacaatttcttcagtgtgtgaacatcacagagtgtacttaaacaaacctagatgggacagcctactacacacctaggctgtatggtatagcctatcgctcctaggctacaagcctgtatggcacattcctgtactgtaggccactgtaacacaaatcactaggggagaggaatttttcagctctgttatagccttctgagaccaccttggtatatgtgcaccatcattgactgaaacttgttatgcagtgcatgactgtaacttcaaggagttacacaggttgaaattaggctgagtgatgatcagatcactatcggagaacctgcaagccagcccttgactgaaggtgtccattacacacaggactagagaagggggctggttcctctttcccatttgccaagcccactctcccctcatcaccaccctgcagacttgctctggcttccccggctgccctctctttcatcaccctgcttgcacctcctctttttcctccccctgttctattccacactccctttacaggcttctctgcctgcctcacccagaggccctcactgaccacttagaactgggagctccacctctctggctggcaggaaattgggtagagagagaggaggtgtatttccgttgttcagagttggagcttgaggttctccctgtagcaatatggtaatgggtggtggataattctataatgctatttatgtgatactcagttagggtggagttaagctggcttttcttttcagcaggtctgggaccctaaccccatgctgagttccaaggaactgaccgccctaaagctgcctgcctgatggtctgagagcaaagtggatcttgcataggccgggggcccaccctcgcccctttctgggccttcgtcttctcatgtgggttggagtggctcttccctaagggtccttccagcttaaacgcacattgtttctgtgactattgctaaagaaaacctgcacccaatctgtctgggacagaaccttgtgcgtgatgtaatttataatcctcttctggggagaattagcattcctgataactgccctattgattatctgatccattgtaaagacttgaagacttgttctggaaatccactgttgagcccaaccagctgtccattagcagtctttagctaaaccttctataatctggcataacaatgactaccattgtttttcctacgaaataccactactaagagtaatctttgaattagcctgctgaagaaaattttcttctagcaagattatgatcaaactttggcatatgcttgtaattaaagaaaagttttcttcagtgtcattcaggagatagtaggtggggaaactacttaaaggtttttgagcaggaagtaatttgttcagagctaagcctgagagtctaaggagatccatggggaagcagagtgcaggatgactggggtaagggacgccgaagtgaggagagcaggtagcaggctgctgtgatagtgcgagacagaagatggcggcttcaagagtggcggggccgaggccctggagaggcgggcatgcgtgaacagccacggcaaggtgaaatcagacacagaaagtgctcagaccctcgtggggtccagggtccagaggagtcagaaatggggctaagtctttaggcctggcgtctggaagaacacgatgtcaggagcacaccagggaagttaggagaaggaaatagtttagggaagttgtgggtttaattttggtcttattcattgaattcatggggaagtgtacttgggtgagctacttggggcaagaaacccctgcagcaagaaggagataggatccttagcacactgtgctgtctgaaggttctgctcactgtggcttgatgtggagagtaggtaccgcaaagaaaatatctccggtccatggtgcctcccaagccaagtgtgtccatagcagcccactctgccttttttttctttttctttccttttttttttttttttgagatggagtctcactctgtcacccaggctggagtgcagtggcacgatctcagctcactgtaacctccgcctcctgggttcaagcaattctcctgcctcagcctcccgagaagctgggattacaggcacccaccaccatgcccggctaattttttgtatttttagtagagacggggtttcaccatgttcgccaggctagtcttgaactcctgacctcaagtgatccgcccacgtcggcctcgcaaagtgctgggattacaggcgtgagccaccgcacccggcccactctacctcttataagaagaagtgctctctgagggcagtcagccaccagaggttagggatggaggtgaggaccacctcttacccatcttggtgcccccagagtacagagtgtggcacccagggagtggcctctgtgatggatctgtttagctacataaaacagaaagatggggacatgaaaacactaagtggcagaaaagatggggctctagtatctttcttccagtccctctgtgaatcatgtacttaaatattatctagtagcccagagattagcaataagttataattacagaataacaatggcagtgacactgcgaagtcagtgtgggaagatctgattgaattaaatacagaaatgacgttgccaccagagttgataagtcatacgaggaaagaagataagcatgggactcaagaaaagcagaaattgagttcttacccagtgctatcagaccctcttccctccctacaaacaaataaataaaaatagtgctggctctcatggcaaaggctaggctgcagtctttagagcaagacaggatgaataaatactagaacaatttgagtattttctatgattaatagctacaattccttttttcgttttgcgtaggtctttgaagcatcaaggttgcatataccggtaagagactgcttttatctgtcaaatctactaattgcccactccgaagaggttgcaattatgccacagtcaactccttcatgttggatctttctctgagaattcactgagatgttatgaatagactgagcttagcattttttttttttttttttttgagatggagtctcgctcagttgcccaggctggagtgcagtggcacgatctcggctcactgcaactttcgcctcccaggttgaagcgattctcctgcctcagtctcccgagtacctggggctacaggcacgtgccactacgcccggctaatttttttggatttttttttagtagagacagcgtttcactgtgttagccaggaaggtctcaatctcctgacctcctgagccatctgcctcggcctcccagagtgctggcattacaggcatgagccaccgcgcccggccaagagcttctaaggatcatgtctgagagtgagtatttctttttttttttttcttttttttgacagagtcttgctctgttgcccaggctggagtgcagtggtgggatctcggctcactgtaaactctgcctcccagattcaagcgattctcctgcctcagcctcctgagtagctgggattacaggtgtgtgccaccacgccccactaatttttgtatttttagtagagtcagggtttcaccatgttggtcaggctagtctcgaactcctgacctcatgatccacccacctcggcctcccaaagtgatgggattacaggcgtgagccaccgcacccggctgcttagcatcttcttgaccaatgagccactccagcttgatacaatggaccatttcaagaggacagaaggcaggccaggcatccccaggggaagagaggtggggttctcttgtgagcaggtcaaagtcagctcaaaccagagcaggccaaggatgcacacatccagtttcatttcaattaaggttatgtaaaagaaccttcagaagttctagtcctgccagctttgaaaaccttctctctgtaagaaccatcccttctgtgttgtttatttccttgagaaaagatattagatattaaagagacatttcaacagatttaagtgttctcagaaaagtgagatgttattcgattaaaaagctaccttagattcatgggtgagcaataaatatttgttgatttgattttcagtcctacttttcaagaagtggaattgaggaggatgttagggaatcatttttgaaagattaaaattagcaaccacagtctcatcttctacaattatattgcagaaaaattgtttattttcctggcatacaaaggagctggctttcctcagctttattttcctctagcgtctgatctacttggtgaaaaatggagaggacaaaggaataacaccaaatacaaagaatattcttggcttaaaaaagaaaaccagaataaacagagagactgctaatgtctctactcttggtaaacagcttatgagaaggctttggaggcaaaacatctccctgccctcactccggcacgtagtttcaatccagtgaaacctcagtaaattgcttcaggaaaatagatgcaagtggatttgcatttaggtgtttcaataacttgaataatttcctcaatactgagcatgacttttgcacccattattagagggggctgaaagagagtggccaagtggcagggttcccggcaggccttactgtgataacagccttcaatcactgccatcgtgatgtgacaaatcatggctttttttggtgcagctgatagctcagggccatgatgtatcaagtacaaacacttgaatgtcaacaacataagaatatttgcccgtaccagttccttttaatgtctgttaaggctctttacagaatccaataaatgtaatcaaagaccaaacaatcaaacaccataaataattctgctgagaaactggagaggccttggccgctgcacactctcccactgccttccccaagagctcgctcgcagctccctctgtcattctctctctctctctttttgttcttccttcctgccgttgtctctatttctaacacatttttgctgctgtgcaacattaatcactgaatattttctctagctttcaaaaacccaaatcaaaatttggttgctcatgggtcccttaacctacttcagtcctaaatgaaaaagactatggaggccgagacacgggcacagggttttaattctgtctcgtctcagaaagaggacagtcttgcaggaaatcatcttactgaccttccttcaggctgtagttctaaagaattttccataaaagctgtccttgaataaacagctcctgccttgcccatttggcctgctgttattctggaaggcttgtatctgtctattctaaatgggtcttttcatctcagacaattcagtggggtgtccaactttcagcagctaaatggtctacccattcctgcatattttcagattttcatcttccataaccacttccataatggttcaagtgagaaacattacccggaaaacccaaaagggaaaaattggatgatgatgttttgatgaacaattttatttagggatgtgggctctactagaatgattctttttttttttttttgagatggagtcttgctctgtcgcccaggctggagtgcagtggcgcgatctcggttcactgcaacctccgcttcctgggttcaagtgattctcctgcctcagcctcctgagtagctgggattacaggtgactgccaccacacccagctaatttttgtatttttagtagagacggggtttcacatgttggccaggatggtctcgatctcttgacctcatgctccgcccgcctcggcctcccaaagtgctgggattacaggcgtgagccgccgctcccagcatagaatgattctttaaatgattttttttaaaggattagacttaggtacattttcaatatacttttatagttttaggtatattttcaatatagttttgcccttcctaatgagaatcctgaaaatatttgagcataaacaaaaaacattgcctcataccgtgatttatttggtatcatcaggcaaaggggcaggttataccattgtaggctattaattaaattaccaggaaaattatttggctgcctgaaccatgcacagtgatcgaacagaagacaggaacccggcgtatgaaggtgctgtttccattttgtgtctggggttccctcaaacacaccctttaaaagcctggtgcaaacccatacgacatgaccatttgcttccttccttccttcttttttttttttttttgagatggaatctctctctgtcacccaggctggagtgcagtagtgcgatctcggctcactgcaacctccgcctcccaggttcaagcaattctcttgcctcagcctcctgagtagctgggactacaggtgtgtgccaccatgcccagctaattttctgtatttttagtagagatggggtttcaacgtattagccaggatggtcttgatctcctgaccttgtgatcgaccctcctcagcctcctaaagtgttgggattacaggcgtgagccactgcacccgttggaccatttgctttctgattggcttccactgtggccttaagtcccccataagacatggctgtgtggcatcttacccgcttggtgagctgagtgtccatcatgaagttatgaacgtgcttctccgctttggtgagttccagctttcgggccaccacggccaccacaagggcagtgcagcctgcaccctgcggggggacatcaagaggaccagaggggaaagaacatatcattaagaggcaagatgagagactcaacacgcctggcggccacgggggtaatttcctgggagtggagtgggaacttgagctctctggctggtcacgaccaagccacaaaaatctgttgaaatctgtcaggactctgatgtcctgacccacagaggggtctgcagtgcctcttgggttgtgctctgcagctgacctctgggaggctgagctagccagtttcaatggagaaggatgctgggtggcgccgaggctttggggggtttaaccaacaactaagcacctggtcagctgccaagctgtgcagcggaagacagaggggccagcacacacgggccctctctccctcaggcaggtctccatcccactgccagctctagaccagcaggcctgggaggaaagaaggtaggccatcagctggggtgcagatggaacacctgccagtggctgagagtgttcctgaaaataatcgaatgaagaggcaatacctttccccagggcttgtttcacagagggcacccaggttggcacgaacacgtgcactcagtgactgtgcctgctctacacttgggctttttcacctcaaggtttacgctatgactcagcacaaggaatcggttccttcctgccttcaccaggaggctcatgaattcaccgtcatgcagagattttaaagacaacaccacttctgctggatcaaaaccgggattttaagtgagcccgcagcagacccttgggattttctggaacagcgatcctagtctgctcggtaggtccgtgccaggggagcccgggggagggtgggcaaggaagcaggctctgctgagcccccagaatggtgggactcactttctctctcctaatcctctgggtgcatacttgactgtctgggaaataagcagggaattccctgcacattccaacattctcccaatgcattttaaaatcctcttcgctaggcttcttggttggcttgtgagcatagggggaattcagagactcactactcccctggctcttcggcaggcagcgggagtcagctccatccttctgcaagcggactcccgtcagagaccatcgccctctgcctgcatgctgtgccctgcgccgccctgaccaccactcatggaaagagatgatgaacttattaaagccaacaaccgaatcctgtatgtcaaacagtaattctagttgccacagaacccagtctagcagttgaggtcccagaatggaaggaatctgtcagtaacatttttggctcatcaggtcttacaaaatgtgtgagaagcagaaaagaatgtttttcaaaggtactataatctataaccgacttggaaggaatgcatatgggtggatccattccctactctctcttttagaagctatttctctctttatcccacaggctgacaaaggctagcctgtgtgaagtttcaatgtggttgaagttcacaatgctttctcctcgtttcccacaagggtccccattaaaacaatctagtgtttctcagtacatttgttggccttgtcacaaagtgaaaagaaccaagtctgtgtgaactttccttttctgacctcattttcctcttttgttcgaggacggctgtgttttttcagcttctgtgacttacaggagactctgtgcccaattttcaaaggatctgggcagttgcacagcctggtctgtagctgtaatcaatttagccatgcctccaaaagcaaaaaatagcttaaaagaagccatcctagagggaagatgtgtgctcccttcccctcgaccggacggagtatcatccctctcctttatatggagttccaaaagtactttgggctgaaagcccaaaaagagggctatatcatagcgttaaaaatggaacatcagatggagagggttctccccaggttccattctccctcctctcgctaggcccaggcaaaactctacttaaatcatccctgaaagctggggtccaataggcctgaagagggagcttccctgttccatgctattttgggaatgtaatcacaacaatcaatcatccaccattccaaatttccagggtctagatggggtgtttcacagcgcttgccatggcccacattttagctggctgattgcagggggggcttttaatgagaagctagagtgttttatctaatgaaccacctgtctcacatgatgaagataaatttctctctggaggcaggacagtggactagatgacacttcccagtttctttcaacatagagatgttatgactcccttgtgagtattcctctagaggatgctgcattcttaacccttaattccaacttaaatggatgctctcagcttcatttttccattgactggatgtaattagggcagtcaccagtaatgacacctaacctggtcttttccattaagaggcaacctaataaagatggggccagacatcagcagccttcataaagtggtggaggaatcctgaagcctagactgctgagcctctgcagactgtgcggggtgcggggcgggaaaatgaagaagggagagaagacaatagaacaggaggggaggggaggagagaggagaaaagagaagagaagaggagaaaagagaagagaagagaagagaaggtgggtgcagggagaggtaaagctgggcagaaaatgagatggggaacaagttgcgttgcatcctaaacagcaagggtcaaggggggaaagagagaaggaggaggctgaagaataagaaaaaatgatgggctgatgggattgagagaggaaggaagaacaaggagcctaaggcttgagccagaagtcaatggtccattttggccctttagaggacatgaaggaagtgccaagggatcccaccctgctgtgtccatcttcaagtggtataaggattgcctgtcccctgggtcccctttgggatgctgggccctttcacttaggtgagttaatagtctgacaggccacagtggcagcctggcagtgctgtgtcacatggcagtgatgcaggttagttttaagagacaaatcaccgagggcctggctaactgtggaatctttgaaatggctggtgggtagagggggtgtgtgaggagggaggaagcaggatgggaaagggtaaacagctgctgctatgacttccctggggtcagactggggggaagagccatgactcagccttttgctttcagatatgccaagtcctgaaccacaggggacatcaactggagtccctggatgtgctctgtccaacttccagttccatggggcgaggggagtggatggggtccacttctgatgagctggaacttcccaaggcacgtgggcgagagggagcaccgagtgcatggagagagggtggctgggacggggtgaacacgcctaactctagagattcggacccaaatctggaccgagactcctccacaccagtcctcccacctcttgttttcaagaaacattttccagctggaaaaccttagaagctggaaaaacaagtatcccaaggggaaaagtatgaggtgttcttaactaaagaagcataaaataaaataaaacacaaatgaaagtgacaaatggaggagggaagcctggaggatttacagttggattctgtttctgcaacagattccatgcaacaactaaaataacatcaattggtttgaaaccaaggtgtttcgggagaagctcatcttctaaaactgacattaagcagatgtcttgctgagccctctttttgcctcctcccgaaatgactcaatttgtgctaccttttacttcatcatcactttcccttggcagttcagaggcatctctcatgaggccattggggaaaagctcagcgtccctgcagatatccagaagcttttgcctgtttgtccataactgatgaagggtctacagagagagtccagctttagaaagaggctagattgaaacaaagttatgccaagcagccttgggggctttggggtcttccagatgcctacagaatcagaaggtcagcattgcacatcttttaggttgcactgtcatttccaattctggatactaaatattgacagctttctctctactgtgttgtcaccatgatcatgaaaaatccttatggaaagatgctggactttaatgtagctgcttttgtgggtgaaatctctcaaacacaccaggtctgtgccagccatggcaagttgttcagacaattatataccctgcttaatggttgataattacattgttactgggattgccaagagaaaacaatgattaagactatttacaggccacacacacacaaatccttcctttcccttcccaagcaggccttgccttggccttcctggtgtccatggtaaccaaacaggaagccctacctttagtaaaggcacttgcaataataattgggagctatacatagtgttgggaggttgggaggaggaggggaaaggatcctcagcaaagtgaaaccctggctaggagtgactcagctagaaaaatcacatttgttagaaaaatgccaccagggttcctcactgtggctgaccccagagtgaggcgactgactttaatttgggtgaaaaacactgacaataaatagaggaaacctccctgttcctgtatatagaaaggtgtatatttatgcacagggttttgtacaaaaagagatgaaaggcctgggctgtatttttcatatggaaggtgggaattggctcctcatcgtccgtttcttctttccactttgatcacacctcaatccacagggaacagaacgctctctctgggggagcactgcacacccagacagcaaaagggggtgctgaaagacaaacagcctccggaccccaaagagaggcaggggtggggccagggtctcgcctgttccgctcagctgtgccagagtagagccaggagatgcggagtccaggaaccaggaagccaggtctttggggtgctgcttcttggatggggacagctatgtgctgagaggggaaaaggtcggtattttaaaataacagaggctcccggcagggcccatccacctactggcaaccctgctctgtgccagccctggctgagagctggttctgaggcacaaagccccaggagtgactctaagaaggaaagatttggccttcagtggcatttcattcctttctggtaagaagcgtctttccccggtttcctcgtgacagttggtgctatgccaagacagactcctactaaccgatgggaggtatttgttctaaagccttgcacttacccgtgatttatcacaaccccagcgctaagctttttgtcattagctgctgtcgtaggacctgcctgctaatagggacctgccctggactggagtcagaaaggaggagagagcctggcccctcctgctcagcaggctgactgccccaagcctgggtctgaccgtctggtccaccaatatcagccccaggaagccaacaagacggagtggggtggggagtgggggcagcccccagccgctgtgaggcgttcactcagaccctgcaggaagacctgcggccctccctttgcactgcagaaaggggtcactgcccttccagaaagagggtcttcatctcttctggaggcaacgggggtgacaaatggaatctgagggatcactgcaaggaaggattttcacaaaggtgtgaggggggctgtggacggggggctgtccttgggagggttgcggtctccagccatggagacccagagccacaccacaagcagcctgaccacttctcaccccgccacctcccccaacactacccaggcttagatgtgctttcctctttcagcctcagtttcctcctctgaaaaaagtgtccaaccctggtctgacactgttctaggattccaggacgaaggccaaagagcagcagctgcctgtcctggacccaaagtgcaatgaggcccagggaacacttcaccaatttgcaactgaaggacactgaggacaccaccaacactgacctgtgtgtggccgcttctcgttttcaaagcactttaacataaatcattgcatttggtccttgcacaaaccaatggggagggcagggcaggccctccatctccactttcccctggaggatgctcaggtccaatatgcagagtgcctggcccagggtccacagtgagcagaaactcagaccccacatccctctcataagccacactgtgatggccatgtgacaggtgagagtgtgtgcctccgcgagagtgtcgagtgtgggtggtagggcactgggcaggagagatacaccttgaaagggcacggcacacctgctgggcacctggagatgggatcacagccttgccaaatgccagtgctgcaaagcacttggcactcagagcccagcccctccataggcagaggtggaagcagaagcctgggaaaggcaagagccagcccagggccatgtggacagccccgtccaggactcaggtcccaaaggccgactcagtgctctttccccagtccctgcttctgtgagttccagctaaacatgatcagaaatggtgccaaggtcagtgggaccaaggcaacaggaaggaggacaataaactgcaagctccagtgctcactggaggtgagcaaactgggtggctgcacagcagtggggtgggcatcagagcattgggccaggaccagcttcacccagcccattttgagggagctgtgaatagaccattaactgccaggagtccaggtctcattcttaccttagaaaagttaactgaaaagtgagaaaccattgcagatttcccacctgacattttatgtgtaggggacacacatgcaggtcggttaactaacagccaccccccgctctgcggctaggaaggcccctatgtgcttgcaagaaagagttcagctctttgccacattttaagggtagggaatggggagaggcgggtactcaccatgatgccagtgaggagacagacacctttcccacagtatgtgtggggcaccatgtccccataaccaatggaaaggaatgtgatggagatgagccacatggcacccagaaagttactagttacgtcctgctggtcatggtacctgccaatgggaagacaggagttagtcgatgaacagccattcctgggagtaagggctgtgggcaaacctagagcggggaaggaaatgagatattttgctgaggaagaggcagcagtgacggtggctcacacagatctctttaggctactgaaggggctgcaactgtgcccacccaggtcccacctgcagccccccgtcccgttggcctcccgccatgagcttggtcccagagataaaatgttttgtcatgatttgcacctcattgtagacatccttttagtgttggtaagatagctttggatgaaatcatgcagtaataaaattcaaattttcccttccaagccgacagtctaaatgtatgtggatgtgattaatctgaaatcacaagctcctgaacagggaaaatgtcaaaaaaaaattaccaaacatattcagcgatttcctctaagaaagttgaagcatctcaaagactggcatctcccgggggtctggagggaagctgtggtggttggggctctcgtggagctgtctctagagggggctctggggtgtccacagaggcctccctttctgagtcagacaggggcttgtagctgccccgccctgggaggaaccaactggaaacatcagcaccatttcctctgcccggatgcctattccaccccatccccttcctccctcccttcatccccaacaccaagacctgctgcatgccaggctctgtgccaagtactgaaatacagagatgaataccacacagcccctgccctcagggacccagcccaagagaggggtttgccaaggaggcagacatctgcagaggggtgcaatcagggggtggacaaggtgccctggggatggaggcagagggcaatgaccttgacccaaacacatgagggtccacagaggtgccacagaggagcaaggcttgcattttccaggcaggcccagaggaacgggtgctctgggcagagaaccctaatgaaagcccagggcttatacaaagtgcagcaagggagctggttgcaggctgggtggcagggctggtgaaggtgagtcctcttccaaaccgttctctaatgggatcagcctgaacaacacacaatagactctgtattttatactgtagggcttcacctcttgataaaatctcctcttaaccacttggaggccactggatggggaaagctaagaacaaagggccagggagaccaaacctactaggctggatagagcagaaaagccatttaggaaccttaatctatggaagtcagttaccattggggcttccgtgagttaatgcacacaacgtgccgggacaggcctagtacaaggaagccccctggaaggattcgctgccgtcatcaggaatctccatgcccccacagggtctgtgcccagcgagtgataggcaaatgctgcttttccttcccttggcgccttaagtgaggcgtgcagggcaggctgcatgtgtagatgcatctagagatgggcctggaaggagacaggagctcagccagtcagaaagggacagggccatcaagtcagggagcagcaagagcatggtatgacggatactgtgcatgtattgagcacctactgtgtggctggcactttgtacgcaaacattctcatctcacaacagtctttaaagtatttcccaggtaagcagcaggaggcacggagacactgggtgacttgcctaaggacacacaggaagcaaagcccatgctcctttcactgtttcactcaacatcagagaggcaaaagcgactggcgtgtgtcttgggaataatgaggaagcttcagtgagaggagagcacctgggctccagtagcaggtgaccagggggcttcagagaccaggggtcagatttaggaaggcctggaattctgggagaagaagcttggatcttgtcttagaggccttagaagagattctgggttcttgagcacaggaatgacaagataacacagcttgctgggaagaatggtcggcgggtggcgagcagggtatctgaagagacaggacacagaggtggggtgaccaggcaagaaacaggtgtgcaaagctgggacagagacgcaggccacagcctttctcacccaccggagcccggccctagcagattcccgcgagcacatcaatggtgggctctccagccccacttgagtccttggccagcaactggagacccagtgggtggcacagcattagcctttttgtggctgtctgcacaaggacatgggtgtctggtacttctggggacatctgaagaaaagataccccctccccaaagctctgctaatgagatggccttgcctgcccactccatctgctatacttgctccccagggatgctctgttaccaccctaggggcccctggctggctgcgtgggcctcatttccctgggctgggcctgcctttgctcccctggctatccttgagtagcacaggctggtggctcccaactctgattcccaggattgcgtctacccctgaccgtgacccagcgcatcagccccctcccagttctgctgtggccttggaaaggcagctgtctccctggcctgctcactctgccctgctaggccctcaggtcaatgcaacccctcccttcccagcaggttgctttctggctggagggatggtggcagaccctatcctcaggccctgtgctgaggcagtggtggaaaatcagactttagcttctctaaagcagcaagactcagtgactgtgggaggggacacagaagggagaagacgtaaaggcagctccacgccacaagcctgcaacacataaatgtaatacagtcacagccagggtcctcagttcttccgaaaaacatttcctggaagataagtcttgggtaaggtctgaagaaatgtggttgaggcagtttagcagtgaggagttgagctgagccagtgatcttgggctgggctgggcttgcctggcttggagctccagctccagagttaagtagctccatggctgtgggcaagtgacgtgccctctctgtcaatcaatttccttatccaatgatgggaggattaagtaaaataacccacaagcaataccagcacagtgacccaaattaagtgctcactaaatgtcagccattattgttgctgagagggcgcaggtgttatcagtctgagaaacaatagacagaaaaatacaggggcatggatttacacgtgcagtggagtggtgaggcattcatgaagatgtcttgaagtttaggctggagaactatttgatacagacacaaaagaaatcaactgtaagttcttggacaaagaaaagacatgagatacttagtatctgaaaatgattcttctacatgaaagactgactaaaggggtcaggccccagataagcagtgctgctagaagctttgcaggtgtccagggagaagcaatggagagccttgaataccgaaccatgaagttaggattaatttgtagcctgccctctgtgcacatcatggattttcttgtgcacgtgggtctccacagtcctcctttccctgcaaaccctgaggattaaactcgtgctccctggctgtttggctgcccttaggatcatggaccatcctattcatatgtgggaggatgccaaggtaaagagattagagatcaaagtggaattacatataaattatgttcttgtgggtttcttttttcattcaccataataaactcctgtgcgtgctaactgtgtgtgctgaggagaggagtgaagatcttgagagtgtccttcgttgtttgtcagccttcagtgatcgcttctctggtgggggctacggaagatgctgagatgaattggacatgcaccctgctctccagtggcttggagcttcgtcatggagataagacatacatgcaactcaccaagcaggaagtgatgagccagaaggctgggctggtgattcaggactgtgggagtagagaggagggagaaaaggtttctaaacctattcacaattttagagcggtttacacatgtcacaaactcacatactaatcttgtgctattttttgcaatagaaaatttgggggggggggatagctccatgtttttctttaaaggctgaggaggaaaagatgtaatttttctttgagctcaagggtagttattacagttactgatttatctttcagggtgtggactatggattttttttcacttcttaacatgaaataaatgagagatacaaaagactgtatgacttggcaaagatggtagagacatatgtctacttttgctcactcaaatcccttacagctcaaagttgttagtctcctacttttaaaaataagcaggcaaccaggaatccccagacagtcaggagtctctaacatgaaagacacagatcaaaccagtcaactaaacaaacaaaaagaaggaactctggatcaaatacagaccattcacagagagaactcttgaaggaaaaatcctataattaacgtaagagagagaaaataagatactggacccacgagacaagaatggaatgctgtatgaaaaaagtcttcctagaggggctggaagatgataaatcgaggaattctcccaaaaagcagaaaaagacaaagaatgaaaatgaaagaaaatatgaagttaggcattgtggtgtgtgcctgtatcccccagctgctcggaggctgaggcaggaggattgctcgtgcccaggaggttgaggctgcagtgagctatgattgtgcccctgcacttcagcctggggacagagcaagacccccatcatctcttaaaaggagagagagggaaagaaaatatgagaaaattagtgaatcagtctcccaattcaaacagtagaagttacagaaagaaacaactggggggaaaagaaggagaaagaaggagagaagtaattattttaaaaatcattcaaaaacaaaaatccccagaacttaagggcatgagtttctagatcaaaggctcactgtccccagcacagtggatgaaaatagatgcacaccaaggcacattattgtgaaatttcagaacaccaggggaaaggagacaatcctacagagctttaggggttttgggggagggtataaaagaggccaaatacaaagaaccagaaattacaacagcttcggactttttgacagcaacactggaagctagaaggccatggaataaagccttcaaaattctggaggaaaattatttccaaatcagaattccaaaccagagaccagaaatctgaattggccaaagtattagttcagtctgagggtggaacgaagacattttcagatacgtaaggttgtcacgggtttgcctcccatgcaccctctctcaggaagacacaggaggtatgcttcaccaaaacaaagaagtaaaccaaggaggaagacaaggaataaaggtaacgagctcagggtgatgctacagggaggccctcataggacaggtgctcaccaggtgcggaggacaacccgtccgggctggagcaggtcaagaggctctgggagacacttccaaggagatgaaattgataggaaacttaatgtgcctgaacatcctgaaaagaggtttagacaactgccagagtttgcacttgcattaatgacgaatacatagaaaactaagcaaacaaacaaacacgatcattaacaactccaggaaaaatgaaaagttctgcaggaagggaaaagttatcatattttttactacaaggctcaactatgaatagagtcaaattagtgttgactgagtaatgtaaacactgattactgctttaaccaaaattatgatgtaattataaaaggaagatgaagggagaggaagagttggaggagaggaaagggagctaaattttcatctcccagagtgggaagggaatagataatacctaaataaaccaaagcatcaaaaggtagcaatacacacatattacttacagacatggaggtaaatactaaaattaattagcaaaagaaggtaaaagtagctgcctctggagaacagtaaatgggaagagctggtggaagacagcaaataccacggaaggattgactctacagtgtatgcacatgtaactttgatcatatcaacagaacaccaaaccaaagagaaaaaacaaaactacatgcaacattaaatgacatcaagaaacacagaaagaaaataagcaccatgaactcaccatccagctccaacctgtgggatctacttgtatgttctctccattcttagtgccccccaccccaggatcatcattaccctgaatgtcatgtttatcatttcctcgtttttcttcatagtgcttccatgtaggcaggattacctaagcaatatgtaatttcatttttcctatttccgaccttcataaggatgaaatcataccacaagagtatggtaggaagcttctaaaatgacctcgatatcccccctcctcttgaggtcttcacacacttttgcaatcctttccttttgagtgtgggctggaccaagtaactggtttctaacacatagagtatggcagaagtgatagactttcatttctgaagttaggttatggtaagatcatggcttctgtcttgggtgatctctcactagttatcttttggatcactctccctgggagaatccacaggccatgtcgggaggcaagcccgtggagtgccacatggcaagggacacagcctgccaaccaccacatgagtagcttagaagcaggtgttctttaagtcaagccttgaggtgagaccacagccctggctgacagcctgacaatctcatgagagaacttgaggcagaggtacccatttaagctgcacctgaattcctgacccacagcaaccctgagatggtaaatgtctgctgtttttagctgctaaattttggagcaagttgttatgtagcaacagataactaatacagtgaactcttctatgaattgcttcttttctgttcaacatatatattatattgacatatgtagctatagtctatttttattcctgtattgtatttcatcatatgaatatggcatgatttatttattcattcacctgttgatggacagtgggatagcttacgggtttttcctctaatgagaaatactgctacaaacattattttttattgacttattgttattgtatttttagagacagggtcttactctgttgcccaggctggactgcagtggcacaatcatagcttactgtagcctcaaactcctgggctcaagagattctcctgccttgacctcctgaaatgttgggattacaggcatgagccacctcacccagcccaaacattcttaatcatagctcctggtacactgcataagagtttctctaggacacatacctaagactgggtttgctggtttgtaggatatgtacatatttcacttcattaggaaatgtcaagttgttttctaagatgccagtgccaattaggcttccaccagaggtggataagagttcctgtttctccatatcctcattaacacttgccattgtctgactttaatctctgccacactagtgggtgaattgggatctcatcaagacttgactttacgtttccatgataaaagcttaagtagcctttcatatgtttctttgtcattcatactttctcttctgtggcgtgtcattcatgacttttgtccacttttctattggcttgtttttgttttttctcattgattctaaaagttatttatatattctagataataagaattttgtcagtttgtgtgttgcaaatatcttcttccagtgtgtgccttgcctttttctctacagtatttttgatgaatagaagttttaaattttactgtaggtgactttatcatcctttaatttataattagcagttatttggtttttgcagaaatcattccctccctgagattgtaacatttttacatattttaaaatgttgcctttctaagtcttcaatttgcctggaattgattttgcatatggtgtgaggcagggatacaacttcatttttttcacatgggtaagcaattatctcagtttcacttaatgtgcagaccatcctttctcctactagctttcaatgctccctctgtctcataaattatatgtggaagtggtactatttcttggttctctattctgttccattggtctatttgtctaaccctgaagttatattacagtattctctgtagcctttccttggtaccttctgagggtctagcacataataggggctcactaaaatacttgtggactgactaaggcctgcatgctgcttttcctgtccctctacaaaagtgaggcttgcttcagtaattcagtgaatcatgttaaaatgatttcagctgttctcttcagcagattaaacctttgtcaaggtggctgccaaattccttgagcttggagtcagttctcactattaataagaactcagcttcatgacactagctgtgatctgttacagcactagggtgacagaaaataagccaaagtgaaatgactgcctcttcttccttattctccaaaagaatttgaatactttttaaaactagttttgtaaaaaaaaaaaaaaaaggattcttttcacatggatctacatgatatgacggctctagccatttgtcctgggtctgatttgtttgttggaaatttgcaggcattgagccagatcctctgcagaactccaaagcagccaaatggactgcttcgtccttgccttccggtcaatcttcagagtcacacagtcagacctgcccactgagctgtgaaccctgtgcttgcgaatttctccaatgaggaagccaacaacacgtacctggcttggccccctggcggcctctgaccccaccggtgcctctctcctcggaacactgccctcctctggcatctgcagcggctcactggcctgctttcctcccgccttcgactgtgcctccttggcttcatgctctgaccaccgcttcagggttgctgtgctccaagcttgccttgcacacatggctctcttgctcctgtcactcctgccctgtcctccctgatgccttctaactggcccttcaggacccacttcaaatcccatcctgacccacccagccaaccccagctctttgcctgtgtctcccacacgtggcatcagcaccatccacctactgcccacacactggcttgcagaaaggccgcaaagctggctggggtatagctgaacctacaggttccagggccagaacacctatgtttgaatccgggctttgcaccttaatgtctgcatgaacttatcctcagtcttcccacctgtaaaagaggataatacttgtaccacctcacagagagttactgtgagggttaaaggagctgatatgtctaaaatgattagagcagtgccgggcacataggtgcactaaaaaaaagtgctattttcatctcgtgtgtctatggttagccttggcatagcagaaagaacacaagatctggagcccagagactgcctttcatgccaaatggctctgtgaccttgagcagatcactccacggactcagggcctgctgcttcttcggggaagcagggtgtaatgatgccgtcctgcctgcctcgcgaggccgcggtgaggagtgaatgtgcacgggctccatcagccttcagcaagtgatacagatagaggtatgtcacagcctctgcaggagcctctcacctggggcttcgtcctagtgacaagggcagctgcacggatgtggagaaagaacaggcagcagatgctgctgtgtaggaaaacagaaactcctcccagcttctccttttaatcttcgctgttcttctgggtggctgcagccccttctcttcatttggtgacttgcagcttaaaccccttatctccatcaaattctgtcacctctgctttcaaaatatctccagaatcggagcgcctgtcatccctggtctgtggccaccctggaccagccccaccctctcaccttgtccagccccaccctctcacctggaccagccccatcctctcacctggaccagccccactctcttacctgctccagtcccatcctcttacctgctccagccccaccctctcacctggatcagcaccgccctctcacctggaccactgcagtagttgcctcactggcctccctgcttctgcctgggcgacgcttgcctcaggctagtcctgttacagtagtcagagaggccctctaaaaaaagtaagacaaaagttcctgtatccctcagaaaaaaagccgaagtcccctggggcccccaacctgggggcctctctgagcccatctcaccttcgcccattggccctgccacctggggtttctgcagctccttcacccagccagctttactcctgcctcagagcccctcacctgctgttcttttcagagatggccctgacttacaatggtgccactttacaatggtgcaaaagcaatacacagtcggtggaaagcgtacttcaaattctgaatgttgatcttttcctagggatctgtgatgcaattctctctcctgatgctgggcagctcgcagttaaccaggtgatcatgagtactctacaaggtcctctacagggcactgtgctgccgggtgattttgctcagcggcaggctgacataagtgttcccagcacgtttaaggtaggctgggctaagctatgatgctcagtaggttaggtacgttcagtgcattttcaacttatgatattttccacttactgtgggtttattgtgaagtaatcccatcataagtcacgggacatctctacttagaaggctcttatcccagataatttcaggcctttgcacaaatgtcagcttctcagtaaggtgttacccgcccaccctgtctccaagtgcactactgccccacacccagcaggccagcttctcccgagtcattcttctccacagcgcttatcaccacctgacataatagatatgtggcctatttttgtatttattgactgacaacccctattacaatataaggttcatggaggaaaggactttttctgttttctttactgctgtatccctagtactcaataaatacttgtccaatgaatgaatgaatgaatgaatggctccacttcgtctttctcacaagccagtgggacaagaccagcaggataagagctgttacctgattttacagtgaatcagtgcaaagctccagtgcgtaactgacctaactaacttctcacagcaactaagcgaaaagactgggactgaaacctgtattttttcggctgctaaagatggcaattgtagtgagctgggcacagggtggggcgtggaggcagcacccgtgtgcctgggcaggaaccattctagcttggcaaaatacccgctcagccactgccagtaggtgatggccgggaggctctgtatgtgactggcattcgaagctattagaagcctgaattagaagctattatgaaaggaaagagactttcatggagtcctgggttttattcccattcccagctctgcctttgtccaggtccccaatataatcaacttctaattatcaagtaccttcagcatgctagggcatgtgattccagctttatggagaaaatggggtgaaatcatcatttcttaagggtattatgagttcctttagtttaggagcatttcagaaatgcttgaggcgtgtgaaagaatcccattgaaattcaaaggcagctgaggaataaatggcctagggtgacttcagggctattactgcttgtgccagtgggtgaattcacattaaggcaaaaaaaaaaaaaaaatagttcgttcttttctcaaaaacaatttcccttataaacatcttaaaatgtaaaataaatggctttgaagactcagggctgatcacaagcctatcaaaccacgtgcccaggacaccacatgcatgtataaagccacccctccatccacttcacctctgtgtcctatttttcaagagttggctttgaatttaggaaaataacgacgttttcctctaccaggtaattcaaggtaacagccctggatctttccaaggcaactctaaatctagtcttttatttccagccctaagaactaacagcatggtgcaaggcctccagttatttttaaaaggagagaaaaccagcaccaccagagcacaatggctccaacaaacaaatgcgacttgccgccaaacaaccacagcttgttcttgctctgtgaaaacgagagtttggttggtgtggctttttctcaccgaggtggtggcatctctgtctccattagtggtttcctgtagaagcttctgagaaactctggaagaggtgggacagctggctggtgtcacacagctggatgcaacctctgcaggcctcagcggggaagcttcaacaccagcactggccaagcttttcttggagtgtgtttctcttctcttgggtctcttggtcttgctcaacttctccaccttgcaaatggatgcaccatttgagggaagccagctgccattccttccacagtccattttcttcttagagggaagcactgtcaacctctttgaaattaaaaaccagatggctcatctggcaaatccttctgagtcagtttctcaatttgcaatgttttctttcttcttattaaaaaaatatttccatgtttcctgatttggaaatgtttaataaaatgcatgaaaatggagaaaaataatatgcttggaagaagcactgttcccatgggaagcatgtcttccacggtatctggagatggcgtggcagagatggcatgggcagagagtccaacagacgggggtttggatcccagccctgccacctgttagctgtgtggcctagggaaggcgcttacctctctgtgtcttgggcttcacttctgtaaaatgaagcagtaaaaccttgcacgggactagtgaaaaatataaaactctgcatagtgcctgacacaaattttggaacttagtaaatgagttcatttggtcagcaataggaatgagccccctcctgtgtgcctggcttggtgcctacttgggaacttagagttctaggaagaaggcagacaccaagcaacaccaaggcaaaaaagggccgcgttacaatggagacaagtgatgccaagttggggcacggggccactgcgcaggggacacacggctatctcagaggagcaggtatgggttgggatgacagtgctgcgggtggagtggcaggctcaggagaaggctgaggtgagttggagggagaagcagggcggggaaagaactctgagcatcttctcaaagttgccagtgctggggtttaataagcagaaccccgtgaactcacaggcacagctggcctgcactgttactcttgccccaaacccctccatcttcttcctccttctcctctatttttcctgcctttgcccctctctgttctttcttcttctctttcatgcttctttttctttttttctcctttgaagcactgtctccacctccctctcatctctcctctcttgttttccctttcacttgttcagtctctctcccaccctcccctgtgaggacccacagaggaagctctgccctagagggaaagggtttctgcctccaaggagctggctatcccttggggacatcagtctttgtttgcttcaggttgattttgcttaatcagcaaacttgcattttgcacccactgggtggccagatacagatggcatcaaatgtcaccaggcagaatcctgtgctgtaaagtggggagggtaacatctggagtaggtgcatgggtccccccaacgtgggacatctctggaggggtggcaggtaaactaagctcaaccgatccccaactctgctcattacctgccctctccctgctgcccaggtcccctgcaaccccggccctcttcctcctgcacctcctattcgtgggcagtcccaccagctatccagccagccacactaggacaccagacactgttcctgagcttcctccccatcactccacatccagtgagtcagtccggtggaggttggctcctctagctctctcaaaactgcccttgctcttcatcccagccaccactgtacccaggggtggtgggggcagcattctgttactacagcagcctccccagctggtgtcccgtcttcccctcaaatcccccttccacactgcagccagggaaatctttctgaaactccagaccctcccctgctcccaatctaccagtggctccccctctcctaggtgtgggaagaggagaggggacgttctcagcctctgcacagcgacacactggggcagacaaacagtctctctggggctaatagtagttgaaggattgacatttgtgaacgatttattttttttgttatggcagtttcaaggctatcctgtgataatatcactctcgctatctggtactctgatttgctttcttcagtggaaaggaagggccgggactccagctagcctgatggaaatgatttataacctggggcacacccacagcagaagtcggctgtctgaatatcatctctcctgcatcgctggaatcaaagaaacaagtacataaataaggttggaaactgttggctgatagaagagtcattccaaaatccttaggctggtgaaaaaggcccgtgcctgctcctgtagcgttgagtgcactgccgcatcttatgacaccccagcaagcaactgcttattctctcctccaatccatgctcccccacctccgagcttccctcatgctggcccctctgcccggaggccccttaggcctaggaaatcacctcctccggaaagccgtcccggatcaagtgccctctgtggagccccttcttccccattctccctcacttctcaccaccggctcttggccatctccacccccagcaccagcctccattggttggttggtttgtcggtcggcaggtgctgagaaagctggtcagagctactgaaggaagctgtgaatgaacaaggacttaggggaaagtgacgtttaaacctggtctcatctcactccctgctgtgggcctctgctttctgtttaaagccattctgggtctctgcttgctctcacagctgctgtctgtctgtggttttcattgagctccacccgcccggggccctcagtctgccgcccgcgcctgcaagctttctctctcctggttgagcctttcccgacatctgccatcagtcacagagcgtgacttggaagcaaaggggcttcacagttcatcgttttttatatacagagagaagaacaacagtagttgggattcttgcaaaatacttcctcaaagatcttagagatgatctacttctcatttcattttatttctggggctatctctgtgtggtaggtaagactggatgctaatcttatttgaagagataacaataatcactatcatttctcaagtgccaatcacgtgccatgtgggccaaagctttatgcgcattactgaatttaatcctcaaaaaacaagactcataactgtcacttcctattttactgaattggaaaattagaccaggtgcagtggctcatgcctgtaatccaagcactttgggaggctgagacagaaggatcccttgagcccaggatttcaagaccagactgggcaacatagtgagatgctgtctctacaaaaaatgaataaaattagcagggcatggtggtacgtgtctatagtcccagctattctggaggctgaggtgggaggatcacttgattaattactagattaggaaacttgcacaaaataaaacatcaattgagtggcagggcccgagtgtgtgcttggacttgcctgcatccacagccctgtctttgaccatattgcaccttggaggagccctgtctttgaccatattacaccttggaggaggtggagacctaaaaagggaggtgagatgagtggagagactggtggggattctctctctctcaggtatctcatcctggatctgtgttataatgagccatgcttcccaggagagtaagacagagccagggctgccctgttcagcagcataggttgcgcactgtgcaactccaaggagtgccagtcacgaagacttcaatgtgaatggcaccccctggagggaagtgctgcataggcagtgctcctggcaagagccctaaagaaaagacgggtgtcttgctcttctcagttatgctttccaaagataattaaaggcaggcagctccccaggcaagcaaatgttgtggaaggcacacaaagctgcagcctcacctaggcagggttagtgtgggaaggacgtgggaatcaccctgtgaccaagaacaaagaggaacagcacagaacaagtaccctgggaaggaattttcttgtttttgtttcccagagcagtggggttcccagggcaggacgtgggagctctggttgggcgtctttccctgccacagagaagacagggtgccaaggaggagcctgggacgtcagggcgagtgggaagaattctgactcagcagaggttgcaaagtagcccccagggaatcagagagagaggaagatagagaaagagagggacagggatggagacagagacaatggctggaaggggaggagtctgagggcaagggcacctgggtgagggtctggcctgagcatgaggggcctgaggacagggatatgcacaataatgccctgacccggggtccccacggccgtggggcttggggagactacgggatgctcccggaccacaagcagcctgcccagggagtgcagctgtccctgacctctcgcctctttccataggcctgggctacgcagaaaggcacatttccctgctttctgggagtgggctctggccaagtgaagcgtcacgaagtctgggatgggagtagtttctcaggggctggtccggccccaactgcccacagccaagtcacctgagccttggtttacatgattaactgaaaattctggtacacgtcaggaataaagctaattccgaaggtcaacactatatggagaaaggaatggagacagccagtcgcacacacttttccctcagaagggcctttcttgctggagaagcttctaaagcctcgaagctggtgcaccccaagctctggagagcagcggctggaagggaaggctccaggcctggtgctcaggccaagggcctcctgcacccctcctcacccatttcctcggccccaggagcagaatgaaagagatatgaagagacagattgccttcagcaatccttttctctgcctcttgaactgagagattcttacttaaggaaaggaaggagcaggataaagagatgacccatctggagatgccttctcacctgtggggtctgaagggaatagagcaaaacccccttcgcatcaactctcacagctctgggcctccctctcttcatctgggaagggtggggggctgggtccatgtgcattagggccccttccagctctaaggagctgtaattctcagagaatgttttcttacccgtttcccacactagatggagagctggttaggtaggggagtgggcagctgcagccctgatccttgataagggtcttaagagaccatctttgaagacacagatgcccaggaggcttgccctaaatcagcctcatggtgacaagtgtcgtggctgtgctcggggtctctgcatacagtgggattctcctggggagcatcagctcagaggcccaggaccccctcagcttctgagctttcctggggcggtgagagcagccctggacacgtggctgaaggcctgggcagcaggggcctgcctgctgtgtcagctttaccatcagagtcactgagtcttggggctccctctagcccagttcacctcattctttttagataagcaaatggaggccagaaagcggagaactgggcatctggtgcacttctcaccacatgctgcctctttctagccacagggcatcagatgtgtgagctcggcagagtccagtcccaggagagagacccttggctgggagctcagacccgcccaactcgcggtgtgagtctggacaagttgcttcccttctttgggctttggtttcctcgtgtgtacaatatgaggatttggctaaagaagctctaaagccccctccagctctaagtcaggtgtttttttggatcacattctgtcccccttctctctcccactcccattctcgggacaactagcagctgggctgactgcagaggcaaaagccaggtgtctttccagacaggaggcctgtggcatcccgtgcagacaagatgaagcaagagtcagcaccagtggaaaccacctagcagccttcatccaggctggccatgcctcagggagctgcagcaggtgcctctcaagttacacagaacttctgatggctcctaacccaaggcttttcaccactggacacctggggtgcctgaaatggggcaggagagggcgtgccagtgccaaggctattataaaagagtaagaatggcaacactcagagtcaccatggaagccaacctgtctgtctgtccccctcccctgactcctccccatgaccccagagaagctcccagagactccttcgtccactgcatccccagcctggctctgttttaagggaagcagccaccacagaagatgcttgttacacgttgccaggcaacaaaaatgctgcctgaaaactaaaacccacctctgactcttcataggactggaaactggcagatgagaggagcctgccagggaacaaaggagaagcatcgagagggaaatgatggagttgagcaaccacagaaggcaaaatgaaagagcccagacagttgtgtaaagtgccagaaagcaaacagatggggaggaaaaactgactcactgaaattaggaagacagacagagagaggaggcatggaggaaagtcctccgggtgttaagtcctcgaaaggcctcctttattttttttctttttggccaaatctgtcatgagtagagatgaggctgttgataaggaagatgatgacaatgatgacgatgatgattccttaggtgaactctggtctgcttttatccagtgcgtgatttttattagatatccctcaagcaatggcacaattctccacagactttcagaaaacataattatcctctaaaacgaagatctacactgccattagcaccatcagctcacccaaatatagggacatcagcttgttagctgaagtgaccttgggctctgggatcttcaagcactgagcagatgaaggaaggaaggagtgatgttcagtctggacagccatgcccagctggcaagggaacctcggagaatgggagtgctccaggtggaggactctgcgggcagcagccccgggccagcagtgagaccctggctcgcttacctcccaaagcctccatttcctaatttctaaaatgggaaaattgctcctgccctgcttacttcacagagtgctgggccacagaggagaacctgtgtagaatgaatggccatgaacgaagatagtgctccttatttattaaaaaacaattcctagcctcctacagaggctgggcactgtagcagacattatcacacagacatgccccctgctgggggcgaggcaattaagcaactccacactatggtgggggagttaccccactgctcttggcctcagtttttccatcagggaaatggagataacaccacaaagcattcctatgaggacactgcatgtcagaagtttctcctccctcggcctgtggtcacccttgactaggctccgagcacccggctcagactcacctgcctccagttctgcatcacgtggcctcagggacaggccgggcacctcaggaatctatcctctaatttctgaaataatgaaaagcctccagacacatttactctctaaataaaatgcacagtttaaattataaacaagacaatttaagaatactggtaactaagtgggaacaatttcacatgttaaacttgacaaaataattctaaagctactactcagttaactatattcacatctacttaactcagtaagtttgacaacatagatgtttactttattaagtttgttatacattttctccaaaaaagtctagccagtcaccagaccccaccccacccctcgaaaacagacatcatggcattcaaggacaatgagccgcttctgcctgtacttactaataggcagtggcttccccctaaaaatcactgtttttctagaacaccaatcacaattcctttcctaggtaccaaacagcatgacctcaaagaaattagaaaatgactgcacagtccaagctgaaagaaaaactttgcgtcttatgttctttctccttttgtctcaacacagactcactctgtaacacacctccccagtggaacacataccccaaaagccctgccacaggcgatcggggtcccaagggcccaggcctcctccactgccctacaagtcagggccagggcagatcatgagcctccttgagccaccacatcctcatccacgaaatagggaccgtgggttccccgtcctgcctgctcacttcatagggtcgtggtgaaaaacagaagaggatgtccagtgttttatgtttcccccagctgttcaggtctcctcttgtttgaacttcctaatcccctgggaagcaggtagaccaggcttacttcctatctacagatcccaagaaagaggcccaggaaaggaaagggctcagggtttatcaggaaccagccagtcgcaggtgcttatttaatagagggcaggtgacttgcccaggatcgcacagctggtccgttgtcaagccaggctatgagcgcacgtttctgactccaggggccatgtgctgtcccttctgtgagcaataaaaccttccatgtaggaatgcaaagtatcattattaccattgttgctgatgttactaaaattgaaccaaaccggttttatcatgggttgactggaattgcatgatggagggccttggtcactaaatttaaaaatatggacttaatcttctagagggagcaattgaaggtttttgaggggtaatagtaggaacggtaactggaagccagaaaagctacttctgtaaactggtgtaagatgacagggatctgtgtcagggaggtagcaggaagagatgacttcaagcgacaccgcagaataagaaccatagagcttggtgcctaaatagagggctggaaatggggctgggagtggcataaggatggggaacgatttgagcctgagagatggttgcagcccaacagcacgtctcctcttcttcattagtaagagcgcccaggaaggagcaatgattaccaataataaagactacattttcccgccatgtgaatgaccaacggatgtaaatgaaagtgacatgtgttacttcgaggaaatgtccttaacaagaaagaaacaaccttattttgtccatttctctttcctgatggctaaaaggtaggtgggatggctggagctccagcagctttcttgaagtatgaggaagaagccacgtaccaacgatggcagggcaacaagggagaaggagcctgcgtccctgatgatgccatagagcagcatacctgctatagacacctttccggacttctttggcgtcagacagaacttctgttttgtttaagctattgttgttttgggtttcctatcacttgcagcctaaaacgaatactaacgggtaaagttcctgagaaaaagaagacacaaacagagaagcagagagagaatttaggggcaacatgatgagtttgatcacagatttgatgcgtgggacatcagtacaggagaagatgtatataaaacttggcatggtgcagggatgtattcaagaactctacaccgccaccaccgcccttctaagtcacttttgtctgttgcctggcctgctgcagtagcctttttagtcctcctagtagttttcttgccacctccaatttactcacaaagatgccaaagtaatatttttagaagcaaccatattgtattactctcctatttaaaacccttcaaaagcaccaggcatggtggctcacacctataatcctaatacttgggaacctgaagtgggagtattgcttgaggctgggagtttaagaccagcctgggcaacatagagagactctgtcgccaaaaaatttttgtatttagccaggcatggtggcttatgcctgtagtcccagctactcagagggctgaagtgggaagattgcttgagcccaggagttaaagcctgcagtgagctgtcatcatgctattgcattccagtctgggtgacaaagtgagacaagaaagaaaggaagaaaggaaggaagaaagggagaaagaaaggaagaaagaaagaaagaaagaaagaagaagaaaggaaaggaaggaaggaagaaagaaagaaagagagagagagaaagaaagaaagaagggagggagggagggggagggagggagggaaggaaggaaagaaagaaaagaaagaaagaagaaaggaaggaaggaagaaagagggagagagggagaaggagaagggagaagaagaagaggaagaggaagaaggaaaaggagaagaagaaggcaaagaagaagaaggaggaggagaggtggaggaggagagagagaggggaggaggaggaggaagaagaagaaggcaaagaagaagaaggaggaggagggggaaagaaggaagaaggaagaagaaggaagaggaagatgaggaggaagaggaggaagaagaaggaggagaagaagaagagaagaagaagaggtggaggatggggaggggaggaggaggaggggttggggaggtggaggaggaggaagagcaagaagaacaagaagccaaaggcaaagaagaagaagacgatgatgaaaaggaggaggaggaggaagaggaagaggaagaagaaggaggaggaggagggggaaagaaggaagaaggaagaagaaggaagaggaagatgaggaggaggaagaggaggaagaagaaggaggagaagaagaagagaagaagaggtggaggatggggaggggaggaggaggggttggggaggtagaggaggaggaagagcaagaagaacaagaaggcaaaggcaaagaagaagaagacgacgacgatgaaaaggaggaggaggaggaagaggaagaggaagaagaagaaaaagaagaagaggaggaggaagaagaagaaacaacaagtaaataaaaagataaaactctttaaaggctttccactgcacttaggttcaaccccacaacatggcactcagggcccttcactttcagcctcctgcccccttctgcggctcagtccctgccacaccccccttcatctgtttactctccttccagtgactccttccccccggctccttgccagctcagggccttggtgcagtcttctcattcttctcagaaggctcaccctcttggtctgtgaagggctcatttcctctcatccttcagacctcagctgaagcatcacctccccagagacacctccaagcaggccccagatgagtaggatcccaatccaatgccataaatttttttttaaaaaagaatcattgcaaacttcttttttccactttcacagtatatgtcatagatttgaaattatctactttttgtttccttacttgttacctgtcttccctggtagactgtaagcccatgagggaaaaaatcatgtgtgttttatgctttaagatatatttaattcctagcacagtgcctggtgaatagcagagctccacacctatacataacagtattattatttagcaagtctctcatgagagcactgcagctcagagagaggcgtggctcaatgctccacttgggatgcatggatgcattcctgtgagagtgcctgcattctccgggagcaagcatgatgaagggaaacggcagaggagggagaatgtccaggtaaaggacagacctgtgtaggaaatagggtatggggggaatcagtatgagatgtgtccagagagcaggagagatctcaacttcagtgctcaaacaatctgttgagaaatctgcgggagcctgagaaactaactattgcttttatcagcaggaaaactaaggcagagagaaatggacttcaggccagccctcaactcccttgctaaagctggaaacaggacaggagcctcttgtctctttgagtcctggctggttcccacgtggctgaaccactcctctggccttactgagctgtggctcttatctggtagtggccatgtggaacaagggtgcaagttgctccctgcaggattcaggctaaacaaggcccttacaattgtattgaagaaaagttaacaatagagcatggggctatagaatggaactgtcaagagtgcccaatctaaacagagatgggccctgggtctcgctccctaattcccaggccattatgcctgggagccctttgccctaagaatatgggccactctcaggctgcattaaaaggaaaataatgccgaggaaatgggaggatgcctaacacttggggcactatgttcgttctggggccttcgcttcatgaggacactgatgaccaggggaggagagtgagcgagagggtggagtctgaccagaagtcctgtgacaatggttgaggggactggagaccactgggttggagcagagaagattcaacctgactttggatactcaagggaccttcagtagaaaaagaaatacctggctgcttcactgggtactcaccgtgtgctaaatgttctacactgtgctaagggctttttgtgaattatcccctttcctggcccaacgtcacctgctagtaagagcataagcaaggctccacgctcacatcttcccagaggtcaatggcttaaccgccagcctatggtacttgaacttctttcgtgcggacccagagaactgagttaggacccaagacagaaactacacgttttaaccaatattaaccaataataggaagagatttctaagtcagagctgtctgcaaatggattggatagtcttttaaagtagtgtcccagagggtgttcaaaagaggctgcatgactctggtcaggttaagtacaagtgcaaggttaatggtagaaccaggggtcaaaccgagtttttccaccctgagttcaggcagtcctgatcacaggatggatcctgtgctggtgcgattgccactgtgtactaggtgttttccccttggctcagctgaaacatgtttaagatatttaaaaggagttttactaagttctgtgccccctctattgtgggagtgtcagagcccatctgggcccgttgcagcatgtctggccctgtctgagagggcccgcaggggctgtgttaccaggcggctcccaggcgccttttgggaaaacaaaatgaccaggtgtgttagggccagcaggcttccagggccactactcaaaggcagccaggggactttggctgcccttaaactctctgtgcagtggggggcaagcaggcatccagaccgaatggaacgaggtggggtactcaaggaatatggcatgtctcacccatattccctctcagctcagcctctgggggactggggccaagtctcagggaacagaggagtctgtattaaatggaaggagaacatcgttttgtttttgtttttgtttttgtttttgtttttgagatggagtcttgctctgttgcccaggctggagtgcaatggtgtgatctcggctcactgcatcctccacctcctgagttcaagcgattctcttgcctcggcctcgtgagtagctgggattacaggcgctcaccaccacactgggctaatttttgtatttttaatagagacagcgtttcgccatgttggccagggtggtatggaactcctgacctcaggtgatctgcccaccttggcctcccaaagtgctgggattacaggtgtgagccaccatgcccggccaaaaaaaatcacatttttaaaaacccttctagcagctgcgctatgtgagccaggaatgcagggctttaccccagcctggcgcgggggccccaagctggcagtggagggcaggggaaacacaggggggtgaagagctgcgctcctgagagccagcctaggacaccaaactcatggagaaggggccctgtggagctgaggtgcccgtcctttgagggaggggtctgcaccggaaatgtagggcacaatgggatcacgaggggcaaacaaaacaaccccaaagttgaaggatggaaaagctgacagaatatggatttcctgcttgactaatgtcagcccacaaatagatgtggctgacgtcacttacaggaaccccttccttttccttacctcagcccctccaaggaggtgggtgggggagcgggtgagaatgaagccccatgcccttaggcatccgctgtaggaaaggaagtcacttctctcctacacacccagcatggcactaactgtcactgtgtaccatctttggcagacttgggaaggaattcattccagtgacaaaggtcagatagtcctccccagttaaagaaggaaccctggcatttaactgggtctccctaaggcaaaaatcctggagacaaaagacactggtgacttcccagcagaagagagtgaagggaaacccaggtttggtgtaatgcagcaaataatttggaataatttggggattgacttgactgaaaaaatggaatggtttctcaatgcaatatggatttcactttgcacccacagtcccaaacttagtgcttcagaatgcaaattttatggaaattttccttgctttaccagtttcttttttattttattttctctctctctcccactttctttctcctctctttcttttccttctttctttctttttgagacggagtctcactcttgtctcccaagctggagtgcaatggtgcgatcttggctcactgcaacctccgcctctcaggttcaagcgattctcctgcctcagtctcccgagtagctgggattacaggtgcgcgccaccacgctggctaataatttccctatttcttgattctcctttctaagagatatcagccattacttataatagctaagtcatgtataattatttaatataaaagtacgaaaaaaactagccacgaatgagcagtttaagtgtcaaagggcacaaaaatactgccaatgaggaagaggaaagaacggctgaatacgagatcacagaacgagaaagcggccgcggagtgggactggagactgtgaatcacgcaggtgaaatcagaatgggatcccactcgagacaggagccaggagctagcagcagccctggagccgccggcccagccctgaagccgctccggctgtcgccacagcgagaggaaacctgaacgctctgctcctccacagcgagtccctgcaggtggggacaccgcccacctggccctccctgcgccccctggcggagcgagcctcggcctctcccgggccccggcctctccacgaccgcctggccgcgcgggaaccacccgcggactcgcggcctctccccaccggaccccgcaacaccgcggggacgcccgggaggctactgaagagccagtggcgcctgcctcgatcacacgtcccctgtggagctccacctgcccgcacgccggctcgggcgctcccataagcggccggccgcagaggggctccaagggaggcgcgcgcccgcgaagaagcactccggccccgcaaaggcgccccgcggccctgtccaccaaggccactggccgacgggtcggaagagagcccttcaagacggaacttgcattgcgcttgttagagaaaattatgtgtaaaaactgagccattcagctttactttccaccccgcgttgatgtaaaacatgagttcctatggaagatgaggggcttcgtcaagtgtgtaaaaacaaatgctacctctttccattaaaaatttatatatgtatattcattctcattgttgaaaatacaataaaaagtaataaaaaatcacatgtaacgtcataagaaatcaacttaatgtttacatgtatgaaaatcacatgtacaccttgggaagctgaggcgggcggatcacctgagaccaggagctgcagaccaccagccaggccaacatggcgaaaacccatctctactaaaaatacaaaaattagccgggcatggtggcgcacgcctgtaatcccagctactcaggagggtgaggcatgagaatagtttgaacccaggaggcagaggttgcagtgagccaagattgcgccactgcactacagcccggatgacagagcgagactctatctcataaataaataaatattacatgtaacacaaagaaatcaacttaatgtttctatgtattttccaggtatttctgcacctatctataaatcggtaatatcctacataatgctattttgtacgctcctttttcaaatattacatcatgaatattttcctaccttactgtaattttcaaaagattgatttttaggccgggcgcggtggctcacgcctgtaatcccagcactttgagaggccgaggcaggtggatcacttgaggccaggagttcaagaccagcctggccaatatggagaaactccgtctctactaaaaatacaaaaacttagccaggcgttgtggcaggtgcctgtaatttcagctactcgggaggctgaggcaagataattgcttgaacccgggaggtggtggctgcagtgagccgagatggcgccactgcactccagcccgggcgacagaatgagactccgcatcaaaaacaaacaacgaagtaacaaacaaacaaacaaacaaacaaaaacgaaaacaaacacgttgatttgattttttaaaattcttgctaactacccatcatatggatgtgccatacttgtttagccattgaaatcctagatgtttacttggtttctcattcttttctattataaactgcaccatgcagaagaggtttgatgtaaattgattattctattaaaatagcttcctagaaagagaattcctggatcaaagttacaaactcaaggctcctgtgacaaattgttaaattgttttccagaaagatggtctaatttccttcttgccctcagcgtaagacaaccccatgcccgcccaccgccaacaataagaagattctccagcactgagttatatttatttaaaattttgtcaactccagaggggaaaaagtaattctccttgtagttataatttgcagttctttgattagagggactgaatatgtgttgtgtgttttattttattggctttttgtatttcttcctttgtagttggccttatcttcagcctatttttttcactggggagataagttcttctgattagtttctaagactgctttgtataatagggatatttacctcttgtcatgtttgctgcaaatactttttctagcataacatttgctctttaaataagttcatattttttgagggactgaaatctaaaattgtgtgtatgatgtaatcaaacacaccagttttttccttcatgtttcttctgagattttatgcttaacagttctttctcctctcagggctgattaaatattcactttgttttctggagcttgctcatggtttcttcttttacatctgactttttaatccacctggaatttattttggtggctggtgagagctagggttccaatttgatttttcatccaagcttccaatttctccattaccatttattgaataatctatcgcttcccagttggttttctttctcgtatattgggttctaacatagtagggtttatttcagtgttttccattaggtttcattgatctgtcattattgatttttcagtaatgccagagggacttaattactttcagttttataatacattttaatatctagtagagaaagccccctcaatggtcttctctttcaaaaaaagttaagctattctcacttatttattaaaacatcctaagaatcagtagttattctccattaaaatttctaattttgtgttttcttttttctcaattaaatttatattttagaagttggtatcttttggatttataaattatgtttttctggtttttaaattcattaattcctatctttgcctttgttataaacttaatcttccctcctgaggtttgttttgttcttctaatggattcagttattttctctgttcatttttttctgtttttgttattaaaaatggggtctccctatgttgcccaggctgaggcagtggctatccacaggcacaatcatagtccactactggctcgaactcctaggctcaagtgatcctcccacctcagcctcccaagtagctggggctatcagtgcacaccattgtgcctgaaaaactttaaggatgtttttcatctgagtacacctttggtcacatcctgagtttttacgtacagggtcatcattgttgtaattttctaatagcctttaacggtagttttgaattctctgttgtaattgaggagattgctttaaaagtcccaccaaaaagttgtcctttaattggagttttataggcttgtggtcagagaatacagcccgagcaacttttctgatgttttgaaatgtgtgaccaagaagttgatcaattttttaaagtgttccctggatgcttaaaaagaagatgtttgtttataggctacaaagtgctcaattaatttaaacatttaaaaattcagattatcaatctcattttttgtataaaattcacagttttactgtatatagcacttttatccatattaaatggttcttttggacaatttaatgatttctgttttgaattcattttggtttaaaatgagaatttctattcgtttgccatctgatttgtacttacctaataaatctttgctcttcatttatttttgggtccttctgttctaggtacttcttttgtaaattgcatgcaattaaattttgcttttaaatctcatctaagagacatttacttttaacaaggaggtaaacacaattatgttgattgttataaattttaagtttgtttttctctgatcttctttcatactttgtattgaaattcttccttcctgcttcctttattttttctgtcttagctatgtgggctctgatgtggcatgggaggtatatgttttcagggtagggaaaaggctctcaggctggtgttggagtctcaagtctgctggctctgtggcctgaggcacatcgctcaacctctctgtgtctcaacatcctcatatacagaatgcagatacagtctcatagaactatggtatggattaagtgaaacaatatatggctgatgctactgttattcttgttatactcataaaattttgcctgtggttcctttaggttttaaaaaaaatatttctctgattgctaaaactgagtaatagggctttattttaaaattctcctctacataggacaacgcatctggcatgcttttactaatcccttctagccttctcctctcaaatttttaatctgaggatttgcaaccctctaattattattgaattattgctttaatttcatacatccactctttccagaatctactttttctttgacattagaatttggagttttgcaactacgcgtaagtttagtcttgatttcatgtttgcctgtgtgaaccaatgtctgcctttctttacaacatttcattattaagatcttaattgtgattcagtctttggtcaactggcaaacgagttccccccaaaagtaaactccaagaatgacttttgttgccctttggttgcctcattcaaatgacagggtggatccaaatttaaaatactgtggaactgttctaatgactctgaatttagggttcctgagggagagtcagctctgggatgcctgtgtgcctctaggattgtttcaccttatgattcaataaattttccagaaaaagaatgtattggggtatgtctaggggtggctcctcctgtcccccacattctaactggaaaagaggaatccgtttcgatctgcctactctgatctaccatccccacacacaacatccccttacctaggccaattctgaaaatgtttactgtgcgtatatttctgattatgcttttatccaaatttatcatttcttcctctgaaataactctaattcttagatttcacctggatcctatagcctccagttctgtcctattcatcctttctcttatctcttctgcattctgagagagctttaaattttttaagtttgtctccacattccacatttttaaaaatgtagtgccatcaatgtggattttcattttgctaaaacaattttagttttctggaactctgtgcttatgtgaaccagatacattttcatttcacatctgcccactcttctctatcataaggatcatatatattctggcaccctattagagatgcccaagactcttctttctttttccttttttttttttttttttgagacagggtctcactctgtcacccaggctggagtgcagtggcgcaatctctgctcgctgcactcttgacctcccaggttaggtgatccccccacctcagcctcctgagtctacagatgcaccaccactcccggctaatgttttttttggtttttttttgttttgttttgttttgtttttggcagagatgggtttttgctgtgttggtcaggctggtctccaactcctgacctcaagcgatccacctgctttgacctcccaaagtgttgggattacaggcgtgagccactgtgcctggccacccaagactcttctaatgttgctttttgtttttcataattaaacatttttcaggaatcttcaggattattttcctcttccttaatgctgcaggtttttctcaaaggcctccagcaggatccctgtcgcctccccaccttccccctccccagccatctatctctccgcctggcaccagaaggggatcgctacaggctgctccttccctacaggaggctaacttctcacttctccagctagagggcagggttcctgggtctagcaggcttcatcccatgtggtaggctactttcctatcctctctaactagtcctctgatatcataaaccagtggtttgcaaacttttaaaatcatgggctcctaccaattaaaaattttttgagcatgccctcctccattatacatatatttattataaattacagacatgtattgctctctatccatttattaaatactagccaggctttatatatatatatatatatatatatatgtagaagttctgatcatttctcccaatagtcccatggatcactgtgcgtgtgccccacattggaggttataactcaaaccaaagcagtccatgaggaaccacagtgcctggccccactgttcccaggctctgctcagttctgctcagcctacagggtttagcttgcaggcttccatcaaccccatgtagggtgcttcatccctgtaatgaccactttcctactgttttgttttggggtttgtttttttttttttgagatggagtctggctctgtcacccaggctggagtgcagtggcgtgatctcggctcactgcaagctccgcctcctgggttcacgccattctcctgtcccagcctcccgagtagctgggactacaggtgtgtgccaccatgcccggctaatttttttgtatttttagtagagacgggggtttcaccgtgttagccaggatggtctcgatctcctgacctcgtgatctgcccgcctcggcctcccaaagtgctgggattacaggcgtgagccaccgagcctggccattcctactgttttcttggagtggaagtaccccttcttggagggggtaggaggttgtgggaaggagatgggaggaggagggagctgtggtcttgcttcctgctgctggcaagtgcaggcctgggtgtctgaggcaggggcagaagagagtacagcaaggaagcctctttttatctccttacaatgggagtggtggctctcttaatgagagaaagaatgggccacaaattgtttttctcctgctttaggagccagatctccagaataaaatttctcattaaaatatcagtatgccaaaagttaaccagcaaaataaaaaacctgttgacagactggaaggcctgggacactgagacagcctgttgcagaatttggagcctcaggagggaccaaagtgaagggtccaaagggtccgaagggaatccactcaagaggacagtaaggtcatttataaagcatggctgtgacagcaaggctcaccccacttcatcaatgttatgggaggccttgttgctcctcccaaggagataaacatacaaaggtgagctggcaggccactgcactgctcaaggcacgctaggaaggctggctctccaacctgctgccgcagtgaggacccggggcctcagatggtctctccaccagtaaagctgcttggcacttgacagtgtaaaatcaggaggttcctccctgagggaggtgggcaggcagccaggagaatcccagagaatgcagagtgccacaactgtcaggcctcggaacccatgatgtaatgcctctctgggggccaaggaaaacaagcccactgttgtcactgccctcccagcaaccaggcgctgccctccccatggcacggctgttctgcgtaattatgatcccactttctctccttgggaggaggaaatatgaaaaacctttgttgtcacataaaaaccaacccaagatatgagaactgtcttttaaaatacatcttgctgtagagagatttccatagcaacttcagaagtgtgtgtatacaactagagataagtccaggctgatgaaagctacctggaatgtgaacaggctctgggcatcagcagctgtggatttttctagaacctgtcatgctgctgtgtgaccctgggcaagtcacttaccctctctgatgcctaaggtgatagaatcatcattagatcaggctgagagagatcaaggcatcctgtccacactaccctggtctgacgcttcagttccccaaagcttcccctgcttccagcttctgtccagtctctggctgaataagtcctggctgaaggcctctgccaatcttacttattatttgacattgggaaacagaatgatcatttaagcttgattctaaaaatagtgcttagtcttggtaagagaagtgctttgcctgtttaggaaacaatatattaacggggcagattcctgggaaacagtctgtgagatgctgagatttgggggtgggagttttactggggctgctctcaggatcaatacctctggggtatagaggaagttcccggatgcagtggtaacagaggccttaggcgatccctcagggaccctggagcctggctgagtgtcctactagaagcaaacggggttaggcctttgaactcccacactgacaaatcccctcgggagcttgctgcccccaggcaaggggtttgacctgaagagagggactcagtcacaaccccagctaagggaaggagagcccgggtcctggagggggcatctgtccccttcatgttgacatgaagcaacatgtcatccactacatggatgtgtttgaattggacatgaaggcagcccaggaggctagtatgataacatggtcaagaccataggcagcagaggcagagaaaacagcaagactgggattcacatgttagtctcagtggccttaagactctgagattgggaaagttgccagtagagtagaggccaagatttcctcgtatgtgcaggattcagcctgggttggtgacacacacatggaagttcagagtcagaaaccagttcagattttggctccacgcttattattaatagctctgtgacctcgggccagttactttctatcagtttcctcaactctcccatgagccttcatgtccaattcaaacacatccatgtagtggatgacatgttgcttcacccaaatgcccctccaggacccgggctctccttccctcaggcaaggtacctctctcatagatctattgtgagggcaagctgggatgacatatggattttacacagaactagcacaggggtgcaacaataacatccaccatgctttaatacacctcatgttatacctaagtctttggtcaaatggccttttcgcaagagaagggaactttcagagaatttccgatttgctcattgttcctctgtgccttggtcttagcgggggcttgtgacccatgtctgcagagagagagagagagacccagtggcccaccagggaccaaactaacccagcctcagcttggaagctatggaaggccatgcaatatcaaataaggtgcatcatctaagtactttgcaaactacattctttaaaacaagcttattttccagtgaaaaatagtcaccccttcttgtgataggttcaataaactacgaaactcacttgcaggtactttgttgcatgttcagccatctgaaatacatgccagagagcatctgaggaagtgaaagacttcaaatagcttaaagggctacgcaaattcaattactatgttaatagacaacatggcttccatcatttagaaaggaaaacaggaagagtataggcccatgtatggtacaagttgggctgttctaattaaaagaaggcagcacaaaattcccaagagttatcaagggatctgcactattattattaactttcaccatcattggattgcagtacatagtgcatatatacaccttgtttgactctaacaataaatcctgtgtccagctttcagataagaaaattgaggtccagagaggtgaagcgaccagcacaatgttgctcagctaacagtaccatgaagagtttggggtcggaacccaagcacatgctttctccattgggggaagagtgtctgcttaccagagaaggctcatgaagccctgtgcagtgtggtcccactcagagcagatgttgcaatgtcagctgctgagtaatggcgaggttctgaataggtgagcatggtgtgtccctggggctctgtgtgtgagaaaggtcttccaacactgcactggctctcagaacctgaacctgcatcctggagcctgaacccttgttctgcggcagcagaatgccctctcagtttgaccgtgtgtctgttggccaaaacgctgaaagaaatgtctgcaaacagaatgtctcaaaaataggtaggagatacgattcaaggcacccatgtagggtgtgttgaggctaactcctctccagacttctttgtcttgtttgatctctgctaggacactggtgcatggaagatttggcaatataatcgtaagtgttgacaaattaagggcgactaccaggatttgtgtaaattacacaggatgcttcaccatacctcccaacataataaaaataatctatctcaagcaaacatagcttcattctatctcaagtgatcctcattttaaaatgaggaaactgtagcccagagaggttaagtaacttgccctaggtctcacagctacttaggagcagaatcacggtttctaacctagatttagactccacatgtcaaatagattaaaatgaatatccagggctgggtgcagtggctcacgcctgtaatcccagaattttgggaggccaaggtaggaggatcacttgaagccaggagttcaagaccagcctggccaacatggtgaaaccccatctctactaaaaacacaaaaattagcctggtatggtggcgcatgcctgtaatctcagctacatgggaggctgaggcaggagaattgcttgaacacaggaggcagaggttgcagtgagcagagactatgccactgcactccagcctgggcgagagagcgagactccatctcagataaataaataaataaataaataaataaataaataaataaataaataaataaaatgaaaatccaggaccccttgcaaggagaagagtcattaaaggcagctcgagggtggtggaaggaggtggcttcagtcctgcccttgagccttgttgatggctgttccaaggagttggcattttgttctacagccctggatctctgtcaggccacatctcccttctttcccatgagtagcttctctgaatgactcccaaccaccagcctcctaaaacaatgtttcccaaagtatgttccatcagtacagtgcttctcaaactaaggtgcatatgaatcaccaggtgaccttgttaaatgcaaattctgattcattcattctgggctaaggcctgagattctgggaactctaacaagttcccagtgatgccagtgctgctggtctgtgaaccaaactttgagtagcaaggtaccaatagtgctttataataaaaaggatttgcaggcaaatacaattaagaaaggctgaaccaaacaaaaataaatggtttcattacttcaggacttctcagagcctttaaaatgctaataagcattattaatacccaagaggagtaagttgcaatgtgttatatgtgagttactgatgtaaccagaatgctttgatatattggtttgcaaagaaggaacagaaaatcaggaaaattctgtgcctttttcccaccttactttggttccaatgctgcaattctagctcatactgaaccccaactcagcactcccctctttcccattgtctcctttcaggtgtctgggtacatgcctgtctcctccatcagaccacatacttcctggcacccctactcctcctcccttccctgtcccagcacaggctctgtactcagaaagccccatgtggaatacctttcacagacacggacggtccaggcagcaatgatccacagagagatgctgaacacgagcagcacagtgccagggcagatggtcatgagcgtcttcatgacaaagcgggtgttgaagttgatcttgttgagggccccgatgctgcgggacgaggcatcggtgaagagcttgctgtgcagcagcatgactcgggcgatcaggtacaggcgcaggaacatggggatagacaggatgatgtccacatcggcctccgcccgggagggtgtgtaggagaaggccaggcgtgccgtccagaagaacttgtactcgccaggaatggggtggatggcgcacaccagcatctccaggctgatgtacaggatgcgctcgtaggtcatggctatccgccagtcatccgcgccattgtcgatcacgaagagctggtgggagcagaaagtccattagtgtggccaggaccaggaagcccacagcagggtccaggcaggacaggtggggcaggctggggcaggctgctgggctcaggtcagcctgaccacctcagcatgctctttaggggccttgctatgtggcaagagccctgtatgtggagtagggagagctggattcagtctacctgggaagccctggctaagacactttgactctcttggcctcactttcctcctctgcaaatcgctgcctgagatatagtgatttataataagaaataatgtacttggtctttatcctggtttaggcacagttcccaaaacgctcggaatttccaaagtgataagtgtcatttgtatgctaatgagatgactagtggctggggtcggtcggggtggggatccagggtggcctcaggatggcgctggttgccaggggaaccaatctggtgatgagagggttggaactttcagccccaccccaccacctcctgagaaggaagaggggcccgaaggttgagttgatcaccaatggccaatgatgtcatcaattatgtcggtgtaatgaaacctccacaaaatcccaaaaagacagtgttttgttttgtttttttaacttttattttaggttcaggggtacatgtgcaagtttgctatataggtaaactcgtgttacagagatttgttgtgcagatgatttcgtcacccaggtactattgggtacagtacccaatagttattttttctgatcctctccctcccactctccaccctcagtgtctgtcgttcccctctttgtgtttcgatgagcttccagatagctgcacacatggaggtccctggacacgtggagtgttgcgtgcccagagagggcatggaagctccaccccttcccatgcgccctgccctttgcttcgctcccatatggctgctcatctgaatcctttgtaaggtcctttataataaaccagtaaatgtgtttccctgagttctgtgagctgctctagaaaattaatgaaaacctgagaagggcgtcctgggaatccctgatttatagccacttggtcagaggctcagataaaacaacctggggctggtgactagcatcggaagtcaggtaaatgtggtgggactgagccctcaacctgtgggagccaacactaactccaggcggacaatcaggcttgagttatattgcaggacactcagccagtgtccattggagaattgcttggtgtgtgggaaccaccccctcctttttgctgaccacaagtgttctatgttgagccacttcccaaggtcccttccagcacacaggtgccaaattggctgtttcacgatggtgagaaagatcaactcatttatattagaaacacatccctgagcccctgccagacctgagctgagccctgtaaggggatgtaaagatgaaaaagtcatgtttcctgcatgagtgaactcacaagggctggcacagattccttctccccactcagagaagggggcagcaagtgtttgctggcagcactgtgctctcagacagtgcagtgaagtgttcacggcacggactctggagccagattgcctgatcctaacactactggctccatgatcctgggcaaattaccgaaccaccctgtgcctcagttacctcatctggggatgatgataataactgctgcatagaggtcactgtgaggctgcagtgggttcgtatatgcaacatgcatggaatcctgcctagcacccagcacactatgtaactattagctattcttatttgtagcattattaatggatctggtctcggtctttctgtaaaatgacagttgggctcagtgatgtctaaacttccttctggccctaaactttcacgaagatgcttcctgctgtcacctcatgaggatggctgttctcacaagaattgactgagcacctgctgtgtgtccagcctttgtcttccggtaagtcccactgtggagtcccaccatatttgatgactgtgaaagggacttcacatccttcccctctggggcctcagtcttcatctgagactgaaatgagaagcctctaaagtctcatccagctccgatgatttgattcttggagggtgaggcctgagatccgggcatatgttcggtgtgggcctcctgtgcaggcacctcacttctgggaggtagtggaatgtttatcatcacactatgccctctctttactgggtccttggccctccagcagatctggctgttgcctgtcccagctcatccacgaacacatcccactcaagactccagcctcacatgctgcctgctccaccaacagccacagagagctgctgctctccaaagctggttatgattgcctttaaggaggagctagcagggtcctgtggcctaacatgagctcaggatgaagggtaccagcatcagcacctcctggctgggagagcaggccatgcatgcatcctgggaaggcctgagctgcaaggccggaagaaactaggctgggttaggagaaattaatgttggggccagggttgggtggaggttttatttaacctggaaatacaccctcagcacagaaagcgtaacagagagactggatcagcgtggatttgcgggggctggctgaaagccgagtgaagccttcctttcctcccttgcacagggagatcagggaatgaggagccctttattctgtccacccaactgtctccttgatggtctgggccaaaggaagcttctgctctgcttcaaagttagtcaccaagcagctttctcactccactttgctgccttccttacagttcagcaagaactgaggacccaggagaggacctatggtaccaggcctggtgtggtgtgggcgggcgatgcttgccttgcttttagcatctacctgtgatatgtttctgcagcaaggggaacattccaggcaattcatgggccctgagaggcacagacaggggaggcagcactaggaggcaagtctcttaccttgccgagcctcagtttctctttctccctgctccgtacccttacagagccatactggagagcagaggagacaatggattgaaagggtttaataaactacaaaggatcatttgttcattcattcattcattcaacaaaaatgtgttgatggccctctgagcagccagccccccacccacccacccatgaggatcctgaagggaaactacagggcactatgggagcaactggctgagaggctcacctggtggctctaatcagggagctgtcatctctgaacaggagacagtacccagcacagcaccagctggagactcaccctcctccttccccagtgcagctgagcctgggtttttccagacataggttttccccagcaattagaaagccctaatggctgctcaaagggttccctctgcttctaactgccgcccgacaggccaagccatggcaacgtgactgcctggccaaactcttcaaatacaaaattaaaaccatctactccgtaataaagaatcgcatctggttactatagtaactgggttcactctgggcaggaatggaagcaacgagtaacagattcctttgattgcctgatgaggagtgggattgtaagtaagagctgaaggggagaatgcaccggcagctctgcccagcgagacgggagggtgctggtccccagctgcctctcaggtgccccgccttggttgtggcttgctggtgcagggaaggtgggggccacatggggtagtggagctggaggtgggagagctagcctgaagtcccccacatccaggtattagccatgtgatctcaggccgtgcgtgacttctccgagcttgtttccacatctccaacaggggaacactgactgaccttggccctgcctgcctcctggggttagtgttaggatccaataatacagataaaaagttggacagtgctttactcactgctctaaaaatgtgagggattattaagctggctggcctgggggcactcgtaaacagtgtgtgtaaagagcgggtgttttgagtagggggtgggggagagttttcaggctgcaggttaaaagcttctgctagacagggctccgctgcaaggttttctgcatctgcagggtgggatgtgtcccagaagatcccattgctgtcccacgtgaggacactctatgcttccttccttctgacccttggaatcacagctctccaagtgtggcctcgctccctcccgattcagagcaagtagcagataccccaaccctgctgtttcctcactctgggtcccattcattcctaacaaagcacaatcccaattattgatttgcatgtgtgaggttttgctgtctctccccttagacatggttctcaacctacttgcgtcgcacattagaatgacttggagggcttgttcaaaaatacccatgcccaggcccaggcccaccccaggccaagtaatcagaatctctgggggtggagccctggcacgggtgttcttcttaaggctcccaggtgagtctaaaatgtaaccagggttgggaccccccaaccagtcacagttggagctccaaagagacaagcgctgtgtcttccttgttccctgtggcatctccagagcctagcccagatcttagcacttagtaggtgttcaataaatgcttatttagtgaattagtaactcccacttactgcgtgcccctggactaatcttccctctcttgggctcagcgtcctcctctgaggaatgagggaatagactagacaatccccaaggtacctcctgctctaagaagccataattctgtggttctacacagaccctcttgctcgcacctcctgcctcatctgtgttctcggtgcacctgagctctccagggacaggaaccgtgcctggctcatctcaccccactcccatgcctgagacgttgcctggcacagagtgggcagtcagtagaatcttggtgaataaaggggtgtgtaggcggatgactgtgtcatatgaagaaaaggacagattgcctgtggcccttgttaaccacccagaatggaaattcctgttgaaaatccattcctaagcctgtgactcacaaaggacctgacaattcatctcacaccatgggaagggacaccctcttattcccaaagggtggttcaacctggaataaactgtcccaggtgacctccaagccttagaaagttctagagcaagtctggaaccaggatcttgagtagcactggaccagaggggctcggggagtgtgtatgtggctccacaaaggactatcctcccctagggcttagtctcagtcatccagccctgattctagaccagcttgactgttggcctctgatggattctggagaagtactgaggtgatgtggacagagtgtggcatggggcagggagtaccgtgggccctcaagtggtctgttctggcctgttccagagcaggagaagccacagaggcccagggctgacaaacgagtctcttcctgatgaggcataggtttgctccttgtactctggcttccctgaatgggaaaaggaaagccacattcttcgagtcactgactctttctgcctcctaagcctaaaaaagtgatttcactcattgagggtatgactgacctgaagatgcaatgtgtcagtaccacagtctctggtttcctgaaaattccattctttcctcagatagttgctctgtccagaggtggctctaggcctaatccctctaccacttaactggtggttctgagaacttgccggattttcagccgttagtataattctgagagctctgggagggagattttatgcaacagtgattccaaactttcctttaaggagcttgtaattagagaaaaaggagaactaacccaactcagttcaatataataattattaagaatcaacaaggttaggccattgtgggtatataaatctgaatcaaacacatgtcccatgaatcagtgcacaatctcaagtagttctagcaaaagacatgcatgattaggatgcaatttgaaaagcttcttgggttacatagggcttcagcagcgcccggaaggcatgcatcagacacaccagagggggcagcttgcagaaaaggccacagattcctcccatcccattcacttacttctgtacatgtgactttgcctctcttccaatcaagaagtacagcctatttctctctccctctctctctgtctctttttttttttttttttttttttttgagacagagtttcactcctgtcacccaggctggagtgcaatggcaccatctgcctcccgggttcaagcgattctcctgcctcagcctcctgagtaactgggataacaggcacccacaaccacacttggctaatttttgtatttttagtagagatggggtttcaccatgttggccaggctggtctcgaactcctgacctccagtgatccacccaccttggcctcccaaagtgctgggattacacgtatgagccaccacgcctggccagtacagcctatttctcaatcccttccgtctgaacttagccatgtaccttgctttggccagtggaacattaaaaagtgtgatacagcagaggtttaaaaaatgtcatcgccatgaggctcactatagacacatggcctcactatccctttcaccccagcctgcagccagtaccagctgccagccatcagaagccgtcctagaccagctgcatgacagaagctcacccaaggtgagaccagcagaagaaccaccaagctgagcccagcccaaatgactgacccacagaaacgtgacctaaattattattttaagccattatgttttgaggtgctttgttatgcaacaaaactaatatataacaaaactaattcttatatttggcacatattagaaaagccaggtcatgtgcctactgtgcccaacattttccttttagattcttatgccacagcccctagcaggaaccctcacccgtccccaccttcccactccactcagttatatttgctggccagtccttctcaagtaactgggtgactggatggggaggagatcagggtcaagggccattccttgatggccattcccccatccccactctccccatggacacatgatttgagatatcaaagaataactcagagcatttaaaaagttattttgcaagcagtttagttgttttgcatacaaagtgttttctcagatgtgaggaagtcagctggtagactgaatcagggaacaagggcacaacagaattaatgggcaggggggccgctggagaaaaacagcagggagtctgggagcagtggaccttgttggcaaatgctgagggtaaatggattcgctggcagctaacaaagaggtcagcatggcattccatccttggacggccagcgagggatagtacagaaagcactttcagttattcagggattcttcagaagcccttggctttcagctgtgggtgtgtcacaggccctctcccttgtcacctgcacctcagggagtccaggtctgacctttccctggttagagtgtctcgccaagcaaagatgtcatcaccagctcaccacaaggccaacgctgaaggccatctggacacctcaggacagggccgttcagctgcaatctctgcagggcctgggacaggctgccttgacaaggagacaaggacactacccagtgcctccagcagccacatggcacagcccgagcttcagacttgcgaggcctccccacatttcctgcaaaggggtaggcatgcagggaagcttgccttttttctttttttctttttttttttttttttttttttttaggataagtttagagtcgattcattggattcactcgtttttccccccattctattttgaaagacttgagacctttctgattttttatttaagcaaaatctgtcattaaaatgttctcagctatcagggaggagagcgtattcctgcttagacactttctgaccaacctgaaaaactttcactcttgcacaactgtgaatttctctaaattaaaggagagaaaatggaaaaagcctttttgtgtactgttctctctctgtggggagaagaacttccgggaaaatttccatcatttaaaaaaacgacacagaaacaaagcaagaagaaaaaattacagattttcttaagatatattatttatatatatgttttatattttatatatatatatatacatatataaatttaaacaccctggagcatatattctgcatgtacaccattactacgggggttaccatggaagcaacatcaaaaatcctgtagtacctaattaggtttccctgaggacaggagctgattgccagtgacgaaatgaacttctgggtttgcagcaatggttggtaaaattaccagtcagcaaatgctccatggaactagaggaagaaagggaggcgggtgggggttgggaagcaaaggtggaaaaatggtggctctaaaagaggccagccagtgaacaggccttgtcagggaagtctatgattctaccataaacaagatgcttagggcgttggggtccacgctaccccgctctgtgtctaagaagaaattgtcctcatctgaaaccatcccactccctgggccatgtgtgatgtcccacagtggctctttggtccggccaggataggcttctcctgagcgcttcgccagagctcacttttggtctcttgcagtgtgtaatgaccactcatgggggttatggagtctgaagtttgtttgggactaacagagaccagtggtgatcataaatcctttcccctgtcctcagttctcagagaaagaaagccaagtttcggcatttgagcgagccactattttttactcacgtagcaggaatttcttgatccctgagcacgtcaccactagggatagagcatcccacctctggccatctgtgtgtggcaagtctctggacctcagattcctcagtgtaatgtgaagacttggatgcaatttgtggttttccattttctctgggctgtggggccatttctttcataagatttttcatgtacgcccaacatgggaaacagacaaattcagagctgttgtagttgaaagggtagagaagaacattcaaagatcaactcactcacctcctcctccagcctaggtctctgtagtggaccccatgctctccatagaaccctttgactggaaatcctttggatggaccagctggtctctagttgtaaggagagacaaggtgtgatgctggaaatcaagtgtttggggtctggttcaagaggtgctcgatgcacaggcagggagctttgccccgatcagcttattcactcattcattcattgagcatgagttgagcccccattatgtgacagtccttggtaagctctagggatatagcaagacaagtagacaaggcccctgtccccacagagcttacatttcaggggaggaaaacagatattaaacaggtaaaccatttaattttagagagtgatgcctgccaggaagagaataagacagggcaaaggaaatgagagaagtcccagacagccaggacagggagggctctctatggaagggacctctgaatccaaagtgagccttgcaaaggtatgcattacagaggggacagcatgtgcaaaaaccccaaggcaggatggagcttagagagttggagagataaaagaaagaagaccaatgtgagaaagaagtgagggatgataccaggtgagaccaagaaggtagcaggacccagatcattgggaccttggatgtcacagaaggagcttcctcaaaggacaggagaccacagacccactcccaccagggccatgtgcaccatgtcaccactttctgaaaacacactgcccacaggttaaatatgcaccacagctcgggcctccgaaacaaaatatcatagactgggtaactcaaaaaacagaaatgtattttttcacagttctggaggctggaagtctgagatcagggtgccaacacggtcaggctctcttcccggcttgcaggtggctgccatctcactgtgtcctcacatggcagagaaagggagagggatctctctttttctcttctcctagagctgcagtcctataggactagacctcatccttatgaccttatttaaacttaattacctcccacagaccctttctccaaggcagttacattggaggttagggcctcaacaaatgcgttttggggagacacaattcagttcatagctattcccttttgtgtcaaaattacccaaaagccagactgtgggccgagccaggtgattctgcacataccatttcattgccatctcataatgtccctgtaagggagtcatacatccatttagcagatgaagaaacccaaaccaagacaggttcaatcaattgcctggggcttgcagcattctgtgtcttccaagtcccacgccctttcacctgccagcctgctaagcaggcactctatttgggggctggccagtttgggctttactttgtcttctaaagaaaactcggctgggcgcggaggctcacgcctgtaatcccagcgctttggcaggccgaggcgggcggatcatgaggtcaggagattgagaacatcctggctaacacggtgaaaccccatctctactaaaaatacaaaaaaactagccgggcgtggtggtgggcgcctgtagtcccagctactcgggaggctgaggcaggagaatggcctgaacccgggaggcagagcttgcagtgagtcgagatcgcaccactgtactccagcctgggtgacagaacgagactccatctcaaaaaaaaaaaaagaaaaaagaaaagaaagaaaactcaagcccaccctttaaatgctcattctcagaagaatctttgctgaccagagaatcaatatatgattaaaataaactgggttctatccctggtgtccacaccacctgggaaacccacatcgttatctgtaatctagactgggctatgtttgtggaactaagaccacggctttcatttccacagatacaatatccatttatcatctttcccttcctcctcttcccgccagtgaacaggcctctatggagacctggtgatggggtccctagcgaggaagagaccatcttagtttaggagcccacttatgcaccccagcatgtttgctaatgaagaagattcctctggacaggcttggggtggggtcagaggagaccaacacagggcttaatatatgtgccctagaaatgaacaggaacactggagatgggggattgtgagctgtgggactggaaggagaggggagctggctaagcagcaccttgggccagtcccatgagagggggaggccggagcccactgaggacttgaccacccatgagacagggacagtgctgagactgtaagatcaggagcatgtggcgttcagcgctgtcttatctgttgtgccaccaccacctcaccccttccccttgctccagatccatggaaatgtcagctaacctagaggccttggtcatgggtccctcgaggagcaacaggaacaggaagggtgcctaaagcggttactaagtacaggatggaggtggagaattcagcagaaagagtttggcatcagatgagctgtcaagagagaaatggaagtttccaagcccccagagaccagtggaaagacaccgggtcccctcctgtgtggggtgggagtttgtaaccaattatatttgaagcagtaaggccaagtgaccccggccaatccttgggttgctgtggccacaccttggtctcatcatgtgctccaccccagccatctttacattgctgccagagcaaatgttctaaaatacaaaccaaatcatgtcacctccccttctagaacctttccgtggcaacccagagtgtccaccctcctagctgcacttggccaaaagggccttttcccacctggcaccagctggcccctctatccccatcacctgccacacccggtgtctcatcccagctaaaccaagttaccagtaacccctaagcttgcgcccttccatcttctgtacaagcactccctcttctcagcttcttcaccagagacctccagatccagcgtcccacccttccacaggcctaagctggtcccttctgactcccaggtggggctgggtgccttcctccagtattccccaggccctgtgccccctgcttgtcacagagccaatccccaaatggcagctggagaaggatggccagacagttggggagtgctagcccccgtttcagggggcggagggagcagggcggcggtctccattaacaatggtaacagcaggggccatgtattgcagcctcactgtgcaccaggtcctgtgctgtgtgccttacaggcaccatctcatttagtccttaacaggattttgagacaggtattcttatttctattttacagacagggaaactgaggctcggagaggctaaataatttactacaggtcatacagttaataaggggcagacctaggctctacagccagggcaggcagctctcttgactactgtgtgtgctgcccccaggctgtgctaggaaggcttgttgggctgagccccagtgtttgcctatcccaggccaggccaataggtgtttctggttctttgtgtgccttggcagatccaggagtcaaaggtttctgtgcatctgctaagtctggggtaagaggtatcgttttctcaacaggaagtttctgataagtttctttccttttgacacatgaaaggatcctgctgaatgtttgggggtaggggaggaacagcatcatcactggggctgctgggccctgattggttctaagtcacctgtttaccactaagggagaaattctttaaccctggcttaggggatatttttagcaactaaaaataaataggtttttggatctttgaacagcctagggagctgaagaactgaggtcaggaccaggtggtggtggtgggcagggagtgtttgttttttccccaactgactaaaaggcccttcacctccttcccaagggccagctgcactgtcaccccttcagggggagcttttcctgatctcccagtggcgggggcagcacttcaaacagcaacaagccatttggtgagtccaacttgttggctggggcctaagcacttttctttttctttttttttttttttttttttttttttgagacaagagtctcactctgtcttccaggctagagtacagtggcacgattatggctcactacaacctctgcctcctgggttcaagcaattatcctgcctcagcctcccgagtagctgggattagtacccagctaccacgagtagctgtgcaccaccacacccggctaatttttgtatttttagtagaggtggggttttgcgatgttggccaggctggtctcaaactcctagcctcatatgatcagccatcctcggccttccaaagtgctgggattacaggcatgagccaccacacctggcctcctaagcacttttctttacatcaactctttgagtctcacaatagccccataagaaaagtgaacatcccccagacctcatagcaactaagtggtggagacaggatttaaaccaagaggccacactctcatctattaagtttccattctggccgaaacctccttcttgatcgtccatctgagccgcattcctgtccacctgcttgtcagcaccctcactaaagcaggggtccttgaggacagacatctccttggtcactgtcctccacagtgccaggcacagcgcccagggccacccaaatgaatacataaagggtttaaggtgtcaaaactatatcaatgtgactgtaaagaaatattttaattgttcaccatttttataatcctcctaaggcaaaagagtcttttgtaacatatgcacaagatagaaaaagaaatcaaagaatattttaaaagaactgcttattataattttttaaaaaaccctggaaacaacctgaatacacatcaatagggaaacagctgaatatattatggtactcatactggggaacattatgtagctgtttttaaaaatgaagtggatctatatgtattgacttagaaaatgttcatgatatattgctaagtaaaaagagaaacttacagcataatgggtatagtgtgattcctcttttttaaaaaagcaaacaccaacacataaaaacaaaaatgcccatatatgtgtatgcatgttggtacatttttgtataagcacacacaaaaggtgcattaatcacctctggctaaacactaaattgttaacactggtactactggggacgcagggagatgggaatcagggaacctattgatttttttccttttgataatgagaacacacctctgtgttaaaagaagcctatattgcttttgtaatttaaaaaaacccaataaagtattttttaaaagagctgtcatggagaaagccacttgtggcgcctaatggtgatgttttaagcatggccattcttggaggaaaaataattgcccaggtcctttcctgccctgtaattttctgtgtagagcttcaaatcccctgggagcccccaggattttatgaatacagccctgctagaagtgttcatagctgagctcctctcacaagtctccccctccaaggccagcctcattaccagatccacagcccctctaactaagccaccttgtgaaaaatacttccagggcatgaagattaaacaaggcacttatttcaaggccacctctccatgtgaattcctatcgtaggcactgaaagccgcgttagtcagtggcccactccgctcccccactgagggcagaggcctaggctccctgtgggaagtggtggccctccccacggttgagaaaggaaacctgctccaccattccctccatttgggagggagggaccagggccagggccagggccagggccagggcatgcggcagccaccatcaccacagcgactgctgctggtgagaggtcactgcggatctggcctcagcgtgccaggtacaatgccaagacccgtggggtacagcggagatcaggatgcaagttcctgatgaaccaggagcttagaactgcgtgtctgctagagatgcgcagaagcaaacaaagatatggctatggagagggccagtttggtgactgggggcactatttgcaattcggggtctgtgctgctgtgtgttcaatgcccacaggtactgccctggatccagacacctggagctctggctctgggtcccccacactagagggccctgcttgacccctccttaagtcacaccacaccccgtggagtcagaagcccacagggccaagaggccttgtctgcctccaccttctaaacccccgtttggatatccagacgcccagagtcccctgtccaaaaaggccccaggcctgcttccagggcccacgctgccactttctctgtcctcccataggctgacgctggctgctggtaggtacatccctaagcctgagaagcagccaaggggtagctggaggagggggcaggatgaagtttagatctgagggctgtggcatccacagtgccctcagggtcttagattgggtcaggagggaggcaagagaggggcatgctagggtctggggcctcagggtctaggcgcctccactggaggctggcccaggccctgaaggaaacagggatggatgggcctgtcggtcaccctttctgactgtctgggatatgaatgacaggagcagcagcagctgcattttctagttagttctgaggtcaggcaaacaggcccctgacactgcctctcagatgggttgtcccaccttcacacacctctgtagcaggcacaggtatacaggcttgctctgaggcgccttctgccgagtgctggccatgttggaagcaccatacaaagtggttgagtggccaaatgtttgaaaaatgcttctcagagattcatcaggctcattagcatattaaagcttctgagacttctaaagaaaagaaaacaagtcggctttgaaatgcagtttctcaaacttatttgaccttgactcttgttttgaagtaacagctattaatatttcaaggaacactgggaaatgcagggtgtgaggcattcagtgtaacagacaatggagggttcattccttcaagcatccatggttcattttcatgaagattaccatagtcttcctgagaggcaccaaatactcccctgccttcctgaactgactccacggagcacagcccacgccgccaaacccgtcagcatccactcgcatcaccccacagcctcctgtgagccagccaccttcacgtgctttttagttattttatttaacaaatacttaacacagcgtttactaggttccgggtgctagtctcaatgacttacacatactagcttctttactcctcatagcagcccttttgtggtgggccttattattgaaagatgaggaaactgaggcatgaagagattaagtgacatgcccaaggtcacacagctggtaagtggtttactcagacccaggcagtctggccccagagtccacgtacactcatttcttattgctgctgtaacacattacttaaaacaacacagatttattatattacagctccggaggccagatgtgtggaatcagtttcactagactaacgtggaggttgtccgcagggctggctccttcccgaagatcaggcgggggaatccgtttccttgcttttccagcttccagagagggcctgccttccctgcctcgtagcctcttctcccaccactccagcctcctgcttcaccatcactcgtcctgcttcctcttcggtagcttcctctgcctcccttttcacaaagacacttgtgattacgtttagatcccacctggataacccaggatactctcctccatctcaagatccttcatttaaccacatcctgcaaagtcccttttgccaggatatccagggattaggagctggatattttggcagggtggtggtcggtggggcaggggggggcattatgattcagcctaccacattatgcttttgaccattgtgctaaatctagtttaatcttcctaacaatcctaggaagacgttgtcattatttctattttacagatttgaagactagggctccaagacgtcagctgaactgccaagtgtcacccaggtagtaaatggcacagctgggacaggaaccaagaagtgaatgacttgctccttcacacctgccctgccatcggagaggcggcactcaggacaggcagggccttgggggattccgaaggaggtgctgcttttgttactctctagactgagccctcctgacatcctaagcccactgaaaacctgatgcgagctatgaatttgctttccctagaacaagaagcatttacagaaacacaccatgtattgcagctagtttctgggagttcacgggccccaggttaggaatgcttgctttttttgtttgtttgtttgtttgtttgtttgttttgagagacagagtctcgctctgtcgcccaggctggaggagtgcagtggtgcgatcttggctcactgcaacctctgcctcctgggttcaagcaattctcctgcctcagcttcccaagtggctgggactacaggcatgcactacaatgcccagctaattttttgcattttttagtagagaaatgaggattcgctacatatatggcaacatatatgttggccaggctggtctcgaactcctgatctcaggtgatctgcccgcctcggcctcccaaagtgctgggattacaggcgtgagccaccatgcccagccaagaacacttgcttttaaaagcagagtatcaaagggatgtttgcacacccatgttcattgcagcattacagatactccttaacttatgatgggtcacgtcctgatgagcccgttgtaaattgaaaatattgtaagtagaaaatgcatttaatacacctaacctaccgaatgtcacagcttaacctagcctgccttgtgtgctcagaacacttacattagcctacatttgagcaaaatcatctatcacaaagcctattttataataaagcattgaatatctcatgtgatttactgaacactgtaaacggtagagtactgtatcagttgctgaccctcgtgatcacagggctgaccggggctctctgccgctgcccaacatcacaagagaatatcatgccgcataccactagcccaggaaaagatcaaaattcaaaattcaaagtacagttcctgctgaatgtgtgttgctttcacaccatcataaagtcgacaaatcttaagtcaaatcatcgttaaatctgggactatctctctctgtaggattcggtactatctgcagttttagacatccaccagggatcttggaacacatcccccatgtatatactgtacagaatttcaggtttgcaggagacaagagttctggagattgtttgcacatcaatatgagtaaacataacatcactgaactatatacttaaaaatggttaggatgaggccaagtgtggtggctcacgcctgtaatcccagcactttgggaggccgaggtgagtggatcacctgaggtcaggagttcgagaccagcctggccaacatggtaaaaccccatctctactaaaaatacaaaaattagctgggcatggtggtgcatgtctgtaatcccagctactagggaggctgaggcaggagaatcacttgaacctgggaggcagaggttgcagcgagtcaagatcgcaccaccgcactccagcctgggtgacagagtgagactccatctcaaaaaaaaaaaaaaaaaacaagttaggatggtattttatattacgtgtatcataccactttttttttttttttctcaaaaagactgctctaaactgagagctcttgcagagcaaagaccacatcaggtacattcttgcggctggtgctggggaggagctcaacagatgtctgcccgcgacagctcagcaggtgggatgggtgatcggctgcctcccgctggctgtggctaacacttctagaagccctgcacaccggagagtaagcaaccagcccaagcctggctaaaaccaaaaacaataaaaagcctcgagaactgagaatgtggaggaggaagacaggacaaaaataaatccagtcactgctgtggtcaagaagaggtggctttcacccattcctcaaaggaacctcgaaagggaacgaaaggccccgatgttaattttagaaatagcttgaagccctgtccaacttgagagtgactctgtgcctcttccacagcttaaagtacctggactttttgacagttgtgctcctctgctgccaaatgaatgggggttgtaatccacttgaggatcttttaaacttcactgctgtttgtatgaatttggaaggaaaaaccaaacctcctctgagagctgactcacgtccctttgggcattgtgccaggccctcagaaatcacctcatctgccaacccatctataataccctgtctgtaaaagcatccttctgcttccactggccaggaagatcgcaaaggaaaccatgtaattgcaagaaaagccaagtcagagaggcaggtgacacgtgttttatgaccaatgaggggcaaagccatagaaagttcagaactgagagtgggtgggagcataaatcctgttgccattgtggtaaaaatgggtggcactcactgtgggaaccttgaaagggaacagagtgccacgatgctgctttgcagagggtcaggtggtcacacagcatcctggggtggtttattccctccgggtctcccccgtctgccatgttccaacaaccatcccagatcctcctccctctaattgggatcatattaaatagcctttccaccagtgacagaaggaggtgggctcttagtggagcccactctgtaaatatagagtaacaacaggaatcagaatgttccactggaaacaggtgggacttgtcctccccatacagactatagaagatgtttacaggactttctgcaaccatcctcatcaagtataatcccagaaaagtaacagcaagctgatgggtttattcaggtaatatccaggagacatatttctctttaaaaggaaaaggaatttgcatgttttgttatggccatcccttattccagtttaactggtccctaagaggctctaactacagcaagagggattttggttagagagattgtcaaaccttgaagaagggtagagacggaaagagagagaatttgagggaagattcctcccagggaaatgttttcaaaatgaaatctggacctattcatgtgggagagaatgcccaccccagaagcaggggattgacctatatgggctccgaagttcttttcatgctgtttccattgagctgccttcccttgcctgtgatgcaggcagaagtttgattttttttctatccctgaaggtgttggcaaaacagaaagtttctctccttcagccaggtctcaggcaacttctagtgtgtatttccccacccttttcatttcccagccagagaaaggggagttcctttagttgtggtcctcggttctgtaccaagagcaggaagctcctaaccccaaaccatcgcactcaggaatattctcaccacaaacacctagaagccaatctttccactccaaatggagatggacaggtcaatcagaaagaacgggctattgaaaagctgtaataaatcatgtgccaagtgaggtgtcagacatgcaaaccagggaatacaaagtcagagagttgtaaatgaagtagtgggttgaagagctagcagtggcctggttctctctgcccacagcaaaggcccagagccagcttgtgcaccacccctcctcttggccaggaaggtacccaaatgtctgttccttggtaagaggctgaccctgaaaagtttacacctggagtttcatccctgtatcttaaagcaaatggggtgatggggagggatgtcgggggcatgggagggtggcagaccccaatgcagcctagagacaaagccaccaggcttgggaattaacagactccatttaaaagttataaaccacctaaaaggattaccattaatgacagtgattaatgcaaactgcaaagtagcaataaatcattaattatactttcaatttttaaaaactccaacaaatcaatattaaatcttacagaacttattcactatgctggggactgttacccaactgttgtggggggaaaggcagaaatagaacacaaaaagcctgcagtgaaatacctctaagaatggctggagtagttaacttagcttgacttgacctcgttaacgtagttgactaagctgacttagtcaaggaatactaaagacctgcagttggaaacccgacctgccccagatctccaaagtcagtgtggaggcggattcattccagggtttgcacataatctgggtgggagagcatccgtcattccatcacactggatcctttcccccatgcatgcctttgttcctcactgatgcatccagccctcgaatgtgcacagcactgtcccagggctagaggttctgcctggtggtttcctgttgtgcgtagaatgtagacaaatcctcttcccaggaccaccaaggctgttgtgctcatctccttcttgacacacaatctttccgaatgctgttccctctgcctagaatgttcttcccttcactctatgtcaagttaatcctattcatcctctgactggatcaatctaggctccttggagtacttaccacagttgtaattttacagtcatttgtgcaattatctgactaatgtctggcctgttctgaggctataagctgcttgaggacagagaccatgtctgtttctatgtccatgttttccccagagcttgcccttaaacatagatgcttaataaacacttgatgaatgaaaaaatgaggcacacctcaaaggagctcaaggtcctggtgggagagactctctttggctctccatgtaaatgactccatcagccctctgctgcaagatcagtcttgcttgtgaagaactgagtcctctgatgggatcagggaccctctgagaggagaaaaaacttgcattatagagggtagactattgttatgctctttattatctttgactattgcctttctggtctccctttgaattagtagattattcagctgtcttgaggcccacaaggaacaggcattttggtccatggatcaaccatggaccaaaggtggacctctgtggagggctcattcacagaggtgcaggagcagcagtatgcctgaggctaggcattgtgcatggaggtggcactggagggaggaaggactttgagcccatctagaaagaatgctgggatcgattggttatgtctgttatggatgcagcatgggaacccagtagcgagcctgtcacacattgaccaggcatactctgaggaggcagggagctcgttttcactgacttcctagagagctctttttcatccaatccctgaggatgtctgctctgtgtaataaggggggctatttcttcacagttagttgtcatggctggatttcccatagctgggtggttccataagtagcctatacttagttactgagacaggcataaatttaggtctttcacatttacacggaaaattctctgaaacgagtcctgtgagagaatgacatcctaacgtgcccaggaaagcagagggaccaccatgcccgtcgcccagcccctgtggtctgtgacacttgtgcagccgctggctaaccaaaaactgaaggtctgggattagattgcctttgcgtaatctgggaagccaagtcccttttctgactggcttctgaagaaagaatctggtcacccattggtaggctgactgcgtgaaagaacgcactttgcaaacataagagcacacacaggggccaccccacaaagccacctctgcagtggtagtgtcgagtcccccacctactgatcacaacgtggtaaggcttctctgaaggttccaggaccatcaattcatgtctggaagtacggtggaagctgcacatcattcactgctgtgccacacattccctgagccacccttctgtcagatgctgtataaggcatggggactcaaagaggcacgggcctggaccaccctcatataactcagtaaatgagcagtgatgtaaacagaggaatatattgcatataagaggtgcagcaagagacgtctgtatgcatgaggctccgtgggggcactgaaagttggtgggggtgggtcagggaggacagctcaggcttaagagatgagaacagcacttggaaggaggagcagtacatgcagaggcccagagacgtggacctgtggggcacaggggactccagggtaatgggcacaggggactccaggttgactggcacagtgttccaggaggaaatggcacagatgtggccgcagagcagggcagggccaattctggagggctctatctgcccccctggggagtctagactgtattctaaggacaaggaggagcagccaaaagttttcagacaaggacaaggtccagtgtgtgtgtctgttggattcctcacagctgtgacgatgaggtgaggtggtgcagaaagggtgaggaggcagggtacaagttagaggcttccctaacagtccacataagacctggtgttgggggatgagtggaggtggcgaatactgcaatcgaaaggtaatttatgcccactggaaaataccttggaagatatacactcagcagtgacggagaaagagctcataaattcttattgccaggtccacatttctccaagagtctggcctcccaggaccattttcctggtctccactccagatctgaattcttgcccctcccctggtctccatagctctttgttattagtctgtcttctttgaattacagtccacagaatatcatctcccacccgtctgggaagaggttgagggcagagctggcattccacgtctctgtatttcccattggtgccaaacatacacacgcacgtacagacatgctttcatgcacacagagatgtctagatatcattttttattgggtaaaaaaaaaatttaggtgcagggactgcccaagttacaattcatctggctgcataggctcacggtgaactagttacaaatttgtggtttgggagacaagtcatgattcaaccgattcaaccgattgtgtccgtaaagcagctgggttcagaagtgtctgaagctgggggcccctgccgctgtcagcatgccagctcaccggtcgatgtgcacagcgaacgctggccaagctgtgcaaggcactccggtggcattggtcaataatggggcaggcaatgaggcagcgcccagaggataagacacatctttttttgattgtgtggcttgttttcttgaggaatgaaagggttttccaaatgaagatagtagaatggaaacaaatgcaaaaccagaaatgaaaaaggcgtttgggatctaggacttaaatgtatctaatcccggtgtgcttgtggacatgggggtgatctgcttggcttcatcagcagcctgcgacaactagtggcctacaaaaagctagccctgcgacagtgtcatctcactcccaatgaagccagtctccgaaggagaggagagggtaagaccatctagaatatccacctcgtccctccccctagaacaggagacagagacagcagtgaggctgggctcacaggtctggccttggggtcccttaatgctcatactaatggttaccatattacctgacattctgtagtaggttgtcctaatttctgtagataatcaaggatggtggaaaaaacctggacttcggagtcaggcagagtagggttcgaattctgactcctccactgactggctgtgtgattttgggcaagttaattaacctctctgagcctcactttcctgaggagataatactgtagtacatagcgaaaggaagtattaatagaaataaatctcacaataccaaagtaactttcagaggtcgcccttgaagctacaaccctaattcatttcttcctccatgaccccccatcactgccacattccgttctttgtctgcatctgaatttacacggacttatttgattgattccttgttattgcctgtccctgtgccttcccactagcctggaagctctatgagggcagggatcatatctgtcctgttcattagtgtgtccccagtgccaggaacagtgtaagcactctttcaatttttggtaaatgaattgaatgagaaacacaaagcttggcatatagcagatgctggaggaattctgatcagtgtgaccccagagacctagaaggaccagaggcgtggacacaggggtgtggctctgcctgagcaagtctctgtaacttgctgtgtggacttttaggtgtcttctctctctaggcctcagtttcctcatctgttcaataagaaggatggtctgatgatgatcactgaggccttctccagcactctctggctctaattgtcttggatcctccacatgggctctggactaaatagaacaggaaatccagctccatcactggagcctccatttgtaactttcagctccatgactgccatactaaatcatcccgagaggccagggtacaattcctgggacagggtagatattgcaaattgccagcagcaactggtagccccacttctccactcccccaacccttatggcccagccaccctcttggactcaccaagacacatctgttagcctcagacctggtttgaacaaacaggaagaaaggaaggacagaaaataggtgggcattgacctgtaccaggccctatgccaggtgctctgacacacagtgcttgcctggtcctctccatagctcaggaacatcattatccccattcacagatgaggagaaggtatattagttatacccatgaaggcagcaaatagcgaggcaggacattcgccaagccttctaactcaaagtctcacacattgaacaatttggtggagtttacaccctaggcctcttatctctgactattaatcaggctattcccaagtgtaatttatggcaagaatacactactaattcaggagcagcctctatgggagacattgtttacactaatgtagtaataagagcaaagaaaagagctgacatttcttaagggtaatggggaccacagtgacaaacacatcacaagcattctctggttttgtccccacaaaaactcaatgagtaggcactgacactgtacctactttgcagattaggggcacgagacttacagagtgtgtgaagttacacaactaagaagtggtggagccaaaattcaaatcctagtctctagttccaggccttccatcctaccacctcactatactgtgggcagactggtgagaccattgctatgaactaacagtcaattacacaacactgacacttattgcatttttttttttttttttttgagacagagtccactctgtcacccaggctggagtgcagtggcacaatcttggctcactgcaacctctgcctcttgggttcaagccattctcctgactcagcctcccaagtagctgggtttataggtatgcacaaccatgcctggctaatttttgtatttttagtagagatggggtttcaccatgttggccaggctggtctcgaactcctgacttcaagtgatctgcctgcctcagtctcccaaagtgctgggattacaggcatgtgccaccatgcctggcctaaagcacactttaaataatgatttatactaacacagttcttattatatgatcaaactgaaaggaaaagaggtcagtggtctccagtctcagccagcattaatgccaaatggattgggtcatactgtgggattaggtcacactgtcggattaggtcaagggctcaagatcactgtcactcattggatgaatgcacagcagtgccaggcatctccgtgttctagccagggcacctctagagattatccctgtgaactgtccaaagagcgtagccagagtctccagaaaacgagggcaggctgacccgcttttggagcccacagagactttcaacccataaagtgaagccaccagggttgtgtcccctcccctgcatagggtcatgtaggaatttgctggaaatgccctagagtgcagttgaaaaggcttagctcctactgaaagcaaggagagcctccactgcctccttcctgaatccgcaagtgccctggggtggggagacctgtgcccctacagcggacagccagctgatcgtggtctggagcttcttggtcagcatggtggcctcatcccacaagagatctggcagcagagcatgggacccaggaaaggtcactgagattagttctgtagctgagcatgaaactgactttgtgctggggcaactgcagctctgcatcccacgttgggaggcagccaccccaccttttgctgcctgcatggtcctgggcaggtcccttgacctggcagcacctcagctgcctcacctgtaaacggaggccacattcatccactcacatgcaggcgaagggtgtgacgtatgcatgggaaacagcctcgttgaactgtagattcctgaacgaatgtaagggagtttgattttcttattttggatcccaaagtcatcattgtcattgtgctgttgtgatgattcattggctgtgttcttacagaatgggacatataagcagctcacttggaaataaaggggagagcttgtcccagatcacagccacagtctggaatcatgagggccacctgcccctgcttgagaaggtgtaagtttcttccttcacccatccattctatcgcagatggatttccattgctttcccaccagggccaagctcctgtgctgatattggtacacggcggtggccccctagctttgctctgtcctcacagagctgttgctctaccacaggacacagataaggagtccagaattggctcagaggatctttctggcccaaaccctcacccaggagatgggtgctcagggccggtgattgttaagagatcccagtacagagctccgagctggccttgttataacctggtgaggatgctagacccacaggaaaagcagacaccaccccaccctgagaagactgacactggcacctcctacctgggcaccagttctgatgccagccagcctgagaaagtgacttcctgggggcccattaagcaggagttccttccctagactccaggcttcaccgggagatgcctgttaggaggaaacagattaggactgtatccatcaccaggtatggtacctcacgcctgtaatcccagcactttgggaggccaagtcaggcagatggcttgagctcacgagtttgagaccaggctgggcaacatagcaaaaccccatctctacaaaaaatacaaagattagccgggcatgattgtgcgcgcctgtagtcccagctgcttgggaagctgaagtcggaagatggcttgagcctgggaggtggaggttgcagtgagccaagatggtgccacttccctccaaccagaccttatcccccgctcaaaaagagaaagaaaaagattctatacaccaagctggccagtggactccagcctccgtcctcctttctttaggattctgggggagatgaggaaaggaggtgggggggagagcctcacccccaacacaggaggccgttcaattttacctggaaagccctgcttcttttctcactgtccccagctaaagggaaccatttatcccggcaaagtagaagaaggccgtttgcattctgaaatgaagcatcagcgtgcaatgacagttaaggtcccaagatacccccggagtcactttttattcttttctatccacaatcattaggggaaaatctctctgcagcttctgtaaaacccattcactagagggaaatagatcaatgagaaagccagagcccagagagcctgtgctggcggctctgaagcaagaacatccattcttccccaagagcctacgccaaaaggacaaaggatgctcgctcccaccccctgaaagaagagttagccaaaaaagttctttaactaggaatctatttcttatcctttattcagtaagaacaaaatctctttctgagagtgacatatcttacacttcaaacaagtgcaacttttgccacttatttttaagtgcgcttgcctgccaaagggatagcaggaatccagggggaggaagaggcaagatggtggaggcacagctgtttccatagctggcatctctagccaacagctgcaggacctggaagagcttgaagagctgacacccccggaggatgcacaaccccggagtgaaagactcggcctccggggctctgtttgctgatgtcagcaccaagtcggggcgcgccaggaacgctctcagcagtctgatgggagtgggcatgcaggcagcagaagaggaaggggccaacccacaagagcaagggaataagaacatggcctttgttcacttgtttcttgattggacaattattagcacttactgcatgcggggcactggcagtaggggtgagatgaaataataatagtaacaaaaacaatagcagctaccatactgaattcctaccctgtaccactgctttctgagcattatttcatgtaatgggcacagcaacccctttaggaaggtactgatattagatgaagaaactgaggcagagaggtttaaacaactagtccaacagctaataaaaggcagagctgggatttaaacgtggatctatttgactcttggctagagaaagacaaatggttgatgtgggcttactgagcttctcagtatgagcaaggcaccaaacctgcatggagctcaagccactaccccgcacccaggagctcactccagagccaggaaggaggggagtttgaaaaaacacagggagcaggggtgggtaagatctattctcaccccaggtgttcagtgacctcagggcagctggccaggggcagggcccaggaagtatggagcccagccctgctgtagagcctgatgtccaagctcaggggctcagcattatccagaaatcaccagatggtaagaaatcaccagtggtgaacagaggatgacctactcagtcatggtttaggaagaccaacagctgcagactaatatggataacccaagaatatgaggcaaaatacaatttctacactattaaagaaaaaaaaaagatccattcatcaaaaccctccagccagggctaggcatgagacttaaccccagggacctgaatgttcccacacagctccacctactaacatgggtgtgcatggagccccatccaagaggcagacccacacaggcccagtggcttcggcctgggtttcctctggctgtcactgttaggctcctttcctggccatattctccagctgcaccagcctttctacttagttgttctgcctggttggaggggagaggctctctgtctttgtgagggcccttttcacgccgtgcatgacaccttcccactctggcctctctcatagctcactgaggctgtgccaagtgccttatgttagggatggagcaattcaccatggagtcacctgggctgcagctgtatgtactggacttcagactgtggccaggctttgtgaagtggctcaaaaatgcccccaggccctagacaccaatgagcctgagggccctccttccctgcccagagtcctagtgactctggaagcctagaaacaaaaacagacatttctgaccactagcagggcacagggatgggttagcaaggctttcacgcaagccccaggctactgtaaacattttgccacaagcaacactgggctgcagatgaaaaaggccagcagtatggagcaggttgctccaacagaggcagtgacactctgagctataggtcagcagtgacacctgtcatttggggatgatctggtgtcattattagctcagtaagccctttataaataaacacgttcatcaacatctgtctgccttgagacagttgtttttcttcaaaacacaaaaactcacaagcccatcaaacatttgcctgccccactgtagtccccaggcagacatgagtttgcatccttcacgtggcatattttacagttagaaaccaaggagcgttgagtcctgtttttaagtgtgtttgaccaagagggaatgggaaacatgccagggtgtgatgtggccctgggcagtgtacagctgttcccacagctgacggagattcctacagttgcccgccacaccggccagcaagctgttaatctgagcgagagatgtgtgaccatttggctggaggggacaggaaggaggcatctgcccaggcagcaaccattctctctacagagcctcacacaccaaggattcacccctccctcctttcccactcacccatggccaccttaccacatgagcattcccagaggaacattttccaatccctgcctgtgtgggcttttaagaccccgtctccccgtgcaactctgcattttccttggatgtcccttttgattgctgtcattgctcccttgttggcatgacacgtcctcctttaccaccctctgcagtggactccagccgctctctgggatgcaccttgaaaggagggtagggctaggatttgaagagactggctgttttcttggagaaagccaccccgttcctctccctgtgaggggcatttgcagcaggaactgggatgccactgacacctttcagattaatgcgttcactcacaaacactaacacaattggctcgaattcacaactcatgaaatgagtctaaggggcttaacagggtgttacagcccacagcttcgcaaatgcggatggatggcaggacaaaacgcactaagagttttttattagtgcttagaattcatgatatgccttcacgaccatggtgaatccccacatcatgatgtccccatctttattattccacagcaacgtggttccaagtcaacactgtattatatcattaattagctgttcacctatttgactccttcccttctccttaccagccctctccctcccaagaccatgaactatttgaaggcagagaacacatcttattctttcccatcctggcactgagtagggaatcggtatctgctgaaattaactgaatcccacagatctcggtgaagacaagagtagtagcaatactggtaacatgagcaaatacatagtcctaatcccttttacatatatgaaagcattagttctcacaccaaccctaggtaacggctattctgatccctattttatagatgaggaaactgaggcacagaaagctagaatcgttcaccccaagctcagtcaggaactggcagggttcggctttgcacccaggcagtctggctccagagtcagacctccaaccctctgcacacactgcctttcaagctgaactgatgcagacaccgaaaacatagtgaattacattttcaaggaaagactctatagaaatatagcatatacaaagaggacattaaaacaattctattctgcagacagccatgcaagaggggcgtgagagatgccagaggagagaatatgccccatttcccatgggagggtcctctctacacatctaatgctgctcggcacacagtcagggttcgagtgaggcggtgaagaggaaacagggggacctgggcgttcagggaaaaggcccaaaaggtgggaggggtgtgttctgggcatggtctaatcagactatggacacaattgtcaggtagggggaatggctgtggccatgggttagttcagggcaatgattctcacattctgatgcactttcaaatcacctggggagcttggaaaaatcgcctctattcaatgcctcccctgagcaattgagcaattgagcaattaaatcagaatccctaggggtgggactcaggcaccagtattattttaaagctcccagggcaattacaaactactttttctcaatccaaatgtgagaagcactggttcagagtttatgcagtattattcaccagtctcttctctgcattatgaactaaaacggtgtgtggggattccaatgggtgggctcttttgatctctacttctcccgctgtggtcggctgtttggggccattctgtgggaatgagctttctctgggtttctagggggccctttagggtagtagtagacttcagattgtgcagctccagttcaaattccaaccttgccacttaccggctgtgtgactttgggtatgtgatctaataccctagcctcagtttcctcatctacaaatagaggattgtggtaggcagaataatggccccccaaaatgtctgtgtccaaatcaccagaacctgtgactatgttataagcaggaattaaggatgcagatagaattaaggccgctaatcagttgactttaaaatagggagattatcctggattatctagatgggcacaacataatgacagggatccttaaatatggaaaagagaagcaggagagtcagtgtcagagtgatgtgatgtgaggcttcctagagccccgtgatgtccgtgaacactgcacgaactagtgtttctacttccagactctattcatgagaaacaacaggaaatggggccgttgtggggtatgggtaggagaagtggaaggttgagaagggaggcccctagggagtgttcctggtcaccagctaagaagggaccgtggacattgtcagcaaggactttggagagttcatctcaaggtgttgggtaccccacctgctgccaagaacaggcaagagctgcaccactgtgcaccagcaaagggctggatttgcagtggtgatctccttagcaaggagagtccaaaattaaagtcaccgaagtctcttgtttgtgccaggccctggtgggccctttaacccagctctctcagctgatgctcacaacatcagcatgtggccagcattatgacctgtttatacagaggaggaaacagactcagggaaattcagtgatttgcccgaggtcacccattagacggcagcagagctgagattagaactcttgattctaaatctagaatcttccatgtcataccatatttcattttcttttcataaaggcctaattaatactgcagtcattattgattcaatcctgagagcatgagaacacagccagtacagactattaatctgcatttcctccttgagatgtgccagccataaaaaatgtagcagcttcaaaaactacaaactagaaaggggcctaaaggaaatttggtgcccaatgaataaatcttatgtcagctcaggattgttgtaattgcagttctgtataatgttcataaggcttgggtttcctgcggtccctgaaatcgaccagggaggtgaggaaggaagcagccattccccaccagggtgcccaaggactcccaccaaattagaatgtggtcccagccccgggaactaaatttatcctgaaaggacatttggatcagaatgttctctgctacaagagatcctgtccctcattgtcctcctctttctcttcttccagagccaggcagtattggctgtaaaactcagccctgtcaattcagcttgaaaaccacacatacacatgcagtcaacccgcagcaacagacaccacatgtttagatttgaaagatgggaaagactgaggcaagcaggaaaggagaggccgaggacatacagagaaggtgaaacaaggtggttttggtgaagctgagcgcagggtcaaagaggaactgagaagaggaaaaaatgtcccctggtggctgtggacaactcgagcccgtaacccaacagcagctggggcaagtcattccctctacagcgccagctgctccttcccaagccacgcagctcctcctacctgcccccgcacttcaaccttttgagcccacttaacactcagaagccccccgcacaaagtcggctttgggtgatgtcactgctgctgcgggtgacagccaggccctggggatagaagcctgctctgggatggtggcggtttccagccaccccaccaaacctgcaaggttgaattctgcaggcaaaggaaggatgtaaactccctgcctgggggagaagctaagtccccgaggctgctggagaagagtgtatttttaggcataggcttgatttgtgaacaataagggaagagcaaaattgtaaaatcctaaggttcttgtgaagtctgatcagtgtcgctcctgctaaacatccaaaaagatccgacagagcaagacaaactcgggctgccctcaagccctggctcctggttgggtggtgttcagtcagtgagatcagaacctcagcgttttggggtgggaggggtgtttttccattcctctgactcttaaacaagagtgtaccaggtggctctcatctttaatcctaacaatctcccaaggagggagattcatccaccattcctctagcccaaccctgtactctaaggtcagagcaggtcccagtgattgaggggggttcaacctgtaccataatctacacccgtctcccatccccattcttacctctcagtctttgatacagactattgacattctctccatcttacataaaatgctttgcaggtgcaacctgaagacaaattccctggcttccctctcccgccatcagatcgccatcccccaaccccttctcatagatagaatggggctactaccattttagacctgggtgcctcatcgctccagctgctgctcaccaggatctggctccagcccttctttctattctcacctttcaacattccctttacgatcagctgcatgcctcccattccgcagagccctgagcttctgcattcttcacagctgctggagctggtcccttcccctagaggaccctcgacccacctgcacctgctagaactgaccccatgaccatctcagatgccctgcacagcagcgtcctcattcccatctaggtggaactgtgcgccgtgccctccacacccttgtcctcagcaccagcagccaaggcgtgtgtgtctgcgtgcttatctctccattagatcacaagcctgtttagggcagggaccttgctgtccccacggtgcctggctcagaacagcccttcaatagctctgtgctgaatgaattaatcaccttttgtccagtcctcaggggagagaatagttgctatttctaacagcagcaggaagacaaatatcgccctgcccactcccccgcctcccattccacacatacacacccactggtggcaatttctctttgctctcaaatcgatatggtttctagcacattctagcaagaagcaccataaagagctgatagggaccttggagagcccttagcttcctccccagatgcacaagtgagggatctgagggcagtgaggggcagggtctgctggcgatcacacagcaggcaggtgtcgggcggctcccgcagagccgcctcgtggctctgagttcagaggcggtggctgctctgcgcccactggatggctccgccgtgtctggttactgatctctggtttgtggctgtgcctgatgtagtcacaggtcagtggtcatagccaggcccagctgctgtggctgagcagtgtctctgagaacgtccagccacggtggccatgcctcagcactctcctgtgacacaacgtgatctcaccgagtgaccaggtgtacggcttcacccgtccatttcacagactcaacactcagccccagcagccaagccccagcaccagcagccacgctttcatttcacagactgtgagtaacacgagaccgggtccagtctgtagttcacagctctgtcccataccaggcaccgtgcccctcacagagcatggctcaataaacacgtgttctatgaatgcagagcaggcttatttgggggctggggtgggagggcacataaaactacaacctcacaggaggccacaaaacttttaagatgaaaaagatttgcaaatccttgaagtttcttctttacttctcctgtctttagtccaaccaaagaaagtttacctcccagatttgacttctggttcgacatttgtatcaatggtttagatgaagctattatactcaggctcatcacatgtgggagggcaggaagctgggaggcccccaaatacatgttgctgagtgagatgctaaaaggcctggacagactagaatgaagggctgaaacagctgcagggaaacgtaacagaagaaaatgaaaggtacagttctcacctaaaaagccaacggtattaggaaggatgggagattgagggggcagagggtggggagctgcttagcagctcatgagaagacagaggggttttagtaaatattcaattcaatataaactaacaggctaccatgaaagctaaaagtcactggctgtctttggctgcagtaacaaagtgagaaagcaggtcggtgccttctgtactgacctgatcccagtggtgtgtaagggtcagtgtgtcaccagatccctgggctgctgtggaccaagcagatcctgttcagagtagcaagatcagggtggaaacaggattattgacatgattatggcagggaagtgggggcatttaatctagggaagtcctgggtccagcttaggggagtttgggtggaaggctgctggcaccttaccataggaacgggcagaaggaggggagaatatgggcggggaaacaggaagagctgctgaagcctgactcacccaggccactggcagcccaaggcacagtgtctaagggaaagaccagactcagcccaggcagatgatggcttggggttagaggcaggtctgatcctgagggcctggggactatcagggacactgtgactccaggcgagcagaagtagaagtcagcccctcagaaggcagggaggcaagaaagaacaagacccagtatggggctcagtgaggcttcaaggaagaccctagccttccttgggatcagaaggcaaggcagagaaactgaagcgggtcccagttctgatggctgggcaggttaccctgagatggctgcccttctacctccccaagggtgctgggcctcatccttgaggcaagccttggacccaaggggaggacaatagggaaaccaggagaaggaagggattttaataggcagaggagccaccacaaggcacagccaaggtgggggtgtggctgggatgagggcctccagagctgctgcaaggttggaccaacactgggttactgttcagccctaggcttcctaatattcacccttgttggagggaagtccccatgactcagcccaccttctaggctgcttctagccattgtaggaaccaggggtagaagagttaatttgaggacgggcctctctcccccaggcagggcaacctggctagctttggagatggtcaactcaaacagttgacctcaaaaccctctgccctcaccagccacatgactgtggacacatctcttaccttctctgcttcagttgctttatctataaagggggtatgaatacagagcctaactacgggactgtcgccaagaatcactgagatgataaagtaaaggcacagtctccagcacacaagagatcaacagatggaggcgacactattaccacctgtgggattaccaaccacttccccaatcgaaacttggaatcagaaccccggcccgtgacgttagggcgatgggacagggtaaaggtaagtttaggggctgacaaagtgggagatgcttgtggagatgatgtgcgaagagagctcaccacaagccttggtggaggcacacaaggccacacagaaaatgacaaaagtcagttctggagatggatggtggtgacaaatatacaataataaggatacaaatatatatataagaatataattagacaattaacgtcactgaaccatatacttaaaaatggttaaaatgctaaattataggttatgtatattttaccacaagtttaaaaagtgttttaaatgaacaagtctcaacttggacccaggtctacggaccgcaggctcagtgtctctcccaccatcatgctaacaggacaggtttgtatgggagatgcctttggaggaaacaaaactgctcaattgaattgcatcgaattctttaattcaaaggtaaatcggggcagttcatctcttttcctcgtccaattgttgggttttggagaatttgagcagtggtgattttgccattttttctcttaaaaacaggaaaatgtcattttactagatttgtactcaacaggaaactagaattatcagaattttcttgatagcacaatgcaacaacacttgtatagaagcctccaaacactaaagattcaacagtgccttccaactttacaaattctcagagagtcaatgatccttaccccaggagtcactgagtcctactatgcacagtgctcttcgttaggcacagcaggggtggctgcagggatgattgggaagacgctggcctccctgagcttaattgagtgccatgtttcttaataagagtgtgcactggcccccctgcggtgctgtcaaaacacacattcccaggcagtggggttcacctgcctatgcaggacccagatatgacacgggggatctgaggcacacccctgattgagaaccgctgccacgggggaaatgatcatcattgaaaaatggtaacaacaaaaccaaatagaacggattaactttgaaaaagtcagggatgacacaccttggcactctcagagaaacagaatattctttttttttctttttttttatactttaagttttagggtacatgtgcacaacgtgcaggtttgttacatatgtatacatgtgccatgttggtgtgctgcacccattaactcgtcatttacattaggtatatctcctaacgctatccctcccccatccccccaccccacaacaggccccggtgtgtgatgttccccttcctgtgtccatgtgttctcattgttcaatcccacctgtgagtgagaacatgcggtgtttggttttttgtccttgcgatagtttgctgagaatgatggagaaacagaatattctattaagctgagcacttgttccccatgactttggagaagtgggagtgcgcgttcatggaaggagtttggaatggattgttaaggcaggggacttggccacttactctattatcctgaaaactttaagctgtctgaccagctcctgtgtgtaagagactcaagaggagtcacctttaaactttaagatgttggagccaaagagctgtctttattattgttttctatgtcaagtttgaggctgtgtttaggggacagccagctctgtgactgggcagaggcaaggctattaagagaagggacagaagttgttcggacagtcccacaaagggcctcctgaacacaaaccaggtcagtcattgttaccaaaaaccgctcacagccactctcccgacattttcctctccttgtcaggcagtgcccctcagacatggaattctggctacaatcagagttctcagagatcctctggcctaatctgcccactttacagacaacacaactgagattgagctagaacaagtagcttgtccaagctcacaagtgatcagcatcccagacaaactggccctggcctctcgtcccatgtagaatgggcagagggttgctggggtgggagccccttgggcagggcagttgttaggctgctttttttttttttttttttttttgaacattttcattctctcagctgcccatgctgggactgtgattttttgtatcctgagttacactggaagcttcctgagaagcgtgtccacggccccctcacttcacatggcctagggcgaggacaagtgtgtggtttccaaggtaacacatagctgggtggattcagcctcccgggccgcctcctcttcctgggaggcttcatcttaagcccgcaggggaggaggcgtgggaggccaggcgacgcaccgccttcccattcacaaacacggactcttcccgaaaccagtctcccctctgtcctcctgccagggttcaagggcagatgacccctccccaccccgtcctgaactcctggagctaaggaagctcctggaggacttggcaagaggcgtttgcctggaagtcaacagaaccccagctgacggggaggtcaagccttaacatgcccggagcagggcttttcacacctgttaatggacacagcaccacccagtgagagcatgatccaggatgacattccccagagacaaaacagaaagtcaatacaggcagccgagaaacaagccttgctgccaccacgagcacacccaccccatcggagacgccagccagggccagggagagcagccgggggccctcacacctgagggacagggagcaggggcaggaaagccccctctgaggcagaaagggttaagcccaagtgtttaaatgtttagcaaataaaaccaaaatgtcacacagagactgccagggctggtgtagtaaccatggcaatccatggccagcggccgatccaagtgaaaaggtgctgggatcgaggtgggcctcccagagagtggcagggagggccatggtgggcatggccagctcactgggcaacctgctgggacccgcagccccttaggatgcagaaagcacgggccagatgccaggtctgtgggcttcaggtcaggctctcagcctgttagaggctctactttctccttagaatgaggagggagtaaatctgccatgcctaccccagttttgtcattcattcattcatttattcagcctacactcattgaatagcacctactatgtgctaggcactctcatgcctttgggggtccaacagtgaaaccaatacagtccccactgccatggagcccacagtcagagaagggagttgcaggcaagaaatagtattcacaaccaacataagacacgcagggacaagtaagagccgctgctataagagctggtgctaggtccactcctagaaggggcaccctggggtcagggaagggggacgatggccagagagagttcctggaggaggaaatatctatgctgaaacctaaaaggcaaaaaggtgaaggcggccaggcccaaggcctcatagatgtgaaaaccctctaaaaaatacaaagcgctagacaagatgtggccacaccatcgtctctgaggcgcttgctaatgtatcagctctgagctttctgtcttcaaagtgtagtctgacgaggatttattccatggtgttctgacttctcgggcccagttggtggtgtagctcctctctctatttctccctttctttctagccccactgtgcacagctgggccaggcaggaggccgaggcccaaagaagagcagcgctccagtgaatccccatcaccagtcgctgttctctggaacacattccccattttcaatttcccttgtgtgctgtgatcatccaggggcacactcatgaaagtgggacaggagagggatgtaaacctggcagaggaggcccccatctggaatttccttgtcaaggtctcctccccttcagtacgagtggcccgagctccctccttccatctgctcatcacacctgagttaaggagctgacatgctcaaacctagccaggctgagaagtctgtctgggggtctcaagatctcggaggttcaatgaaggtatttctaattcatcaaccaaccagccagagacacccttaggaaacctctaccaggtgtctgaagaaggatggggactctagcccctacctggggggtttgggcagcctccacctcccttcggaggacaggcacagcttccttctctttttttttcctctcctgaaacgctctgggccagctttgtcctgagcatacaaggtctctgctcctggcgaatgcagggcacagcatcatctccgcgtgaaacctgcccagcctctctgggagaaatgcatcactccctcctccgtggccacttggtgtttcacagaccctcatattatggcacttatgaccctgggtcacagtggataaaggtctaggacaaaccaatttccaaaggcaggaatcaggtctgctttatttctggattctcaatgcctagcacaaagtagtcctacaataaatgtttgttgaataagtaaacgaatgaatggactcaccatttttatagactgtactagggttggaaaatttagagaggtcagtacgtgctctgctattataccttgtctctcagtgccaggacaccttacaggttacattcaggatgtgacttgagcctgctttcttttacagggagaagggagggtgagggcacagagcaagacgcaacgtgagttgtcctgtctgttctttcaggggaagacaccactaactcatttagcggtgggaccccaaagcacctgggccagcaacacctcctgcattacagacacccatgtccctgtgacagcacattacacgcacccaggaggacactcccatccacagagcaattatgccacaggaagtgaggcttcctataatttatgtcctgtaatttcaagtaatttccctgtctgctcagaactctattggtatttaatgaaaatatccacttttatatacctaataaattaaaagcctcccctttttttggtcccttgtatttcaaattcatgaggttgaaggcccatagtttgttactaccgttacgtttctgttgagtttgaaaaagactggaaacatctgagaccaacgctagatcttgaggggattgatatccccaggcaagagtggatctccaccccattgatctgattgatgccttttactttgaatatggccaagaaccacaatttgaaattaatgatctctgaagctcccattctgggactggattatatgaactctgccactgctctgtatcccatcctgggtcacagtagtctcttcagtttaattcaataaacattcactgactacctgctacgtgcccggcattggcctggatgtagggacggcacctcccatccctgcaactttattaaggatgccaggctctgctccacgcctccggatgtgaatgtgtctgcaccccaccccttattccatgcctggggctctgagccaggcacttcctcccaggggtactggatccctcccatcctcccttcctcactcctgccccagctctgggcatcaacacccctcacctggcccatgatgacgtgcttcccactgtcctcctgcctctgaaattggcctttcctatatttgcatgctgcagatgaagagtgctgtctaaaatgtaaatctgatcatctctgtccccagcttgaaaccttctcatagtttctgctgctgcctacaggacattccaaaacccttcagcaaggcaaacaagtccctacgggtccttcccaccctccatagtgaacttgcccctctacccaggaccctgtccttgagacattcccagtgtgctctgcagttccccatctcagagcctttgtttactctgagacctctgtctggggtatcctttccactctgtcagccagacaaacacattcttacttaagctaaggagttctgcatatattatctaatttaatctgtacaataaccctttctggtaggtactggttccgggtgggtaggcatattcaaacctacccccaaaggctgaggaagctgaaaggctgaagaaaggggctgacatatccagtttctcagaaagaagcatttaatagggacttatgaacaaaagccacagtctctggcagcagtaagacaagatggtggatcctgcaccacgaccccctagtcccagggattaaataccagaggaaaggggtatatgtgcttcagaagcaatttgcctaagggcaggacttacagtaaacagtagataaaggagaaatcttagaggctttcccgaaactgggttaatcggaagtcaatatggaggatcagcatccaagatggagttgctgtggcctccacagtatggttattagtcctattttacagaaaggaaatagactaagaaggattaagtaacttgctaaaggccacctacacactaaatgtgacaaacagcatgatttgcgccaagctgggctgctctgaagtctacattctcagtagagaacgttcctcaagcctgggtcataactgagttttatgattctgcctgctagcctgccttccaggatggcaccagggccattcattagagccatagattcactcaaggctgatgacccctgggagaagcaatggtgaattctgagtttctcatctagagaactgggctcctgtcctgggctctgcacctagaagaacattattaaatagatgctgaaccaatgactgcacttggtgggtcatcaagggcaaaggaggagaggatactggggagcaagaggagttcagtgttttgtgtgtggagccaggggctgccggtggcatgtaaaacgtgagcctgcagcctggggaggggattagcacggtctgagagctgttggtgagagctaaaccacagaagtaaatggactctccaagggagagcatggttttcagtcagagttttggtaaataaacaaaatgcattgcttcttgtgttttcatttctctcccggacacactggcctgaggaaaagaggtgcctgagtctttgaaaggtccgtgctccaaaacgccaacagagagggagactgaggagagatggggtggggtgccatcttccaacaatggaggctaccatgcgggaaaccaaccccttcttttccctgctccagaagcagaaccaggccagggggcaagttccagggaggctgcctcttctcggcagaagggcgggctttctaaagacattggtagggcagcctctcccaggggggccagcagctccgtcacagtagcacacacagaggccctggggttcctgcactaggtggacactacagtttaaacgtgtcccctccaaaattcagatgttgccaatgtggtagtgccaagagatggggcctttcagagatgttgaggccatgagggctcctcccttgtgaatgggattgaggcctgtatcaaagaggccccatgcagtgttcagtccctcagcctcctgccttccctgcctgaggatgcagcaacgtagcgccgtcttggaagcagagagcagccctcaccagacaactgaagctgctggcaccctaatcttggacttcccgatctccagaactgtgagaaatacatttatgttccttataaattacccagcttgggtgagagttacccaacagtgttttagaattcttcttcctgaaaaactcaagccatctaaatgaacaagtaagaatactgttctaaaaggtactcccccagcctcacatgtgtgctgggcagggcctgggtcctgggtgtgagcttctggggcaaggctggggaagacggggacatgatcatctggtccctgctaaaatttagctaggtgatcaggaaccactgtggatgaggaaagctgtgagcagattcctagcaaaggtcctgacatcacccaaaggggagatgcggcagccaccccctgccctgcctgcttcgcaacaggtgagcagcagctggcctttgcctgtggaagggtgcttgctaagcactcccctctgcataacttcatcagtcacacttgggataactccttcctccactcgcaggaagcaggttccgcagctggctgagcagccagatctaaatcagagaattacaagattggggggctaagtaatagatgaggaaactgaggcccgagaccaaaaagctaagtcaaggtacgaccagctttggaaaagagttaccttgaactcagcatgctttccattcaaagaacgtgctacaaacgtgctatactctgccgagaagagtatactgtcagacactataagtctctggacatgcaaagattaatgcaaagataactgtccctgaggtagggaagaaagacacccaacagaaaactacaatatggcccagtgcggtatatacaagggcgctccgtaggaacctccctcccactgactctctgggcccaaactgttcccatttccctctggcaagagaaggtctagctgggcacagaaagaactttactggaaaggtaagaggcacagaggaagccggttttggtgactttcctcaagtgacggaggctgcagggaggataaggggctgggtggtgggagctcagggtacaggcagggctgggccagagcaggaggaagcccagccacctgccagtaccaggcagtcgtgatagtgaccacctggtggacccagctggtaagtgcaaggcccagctagaagcagtgggacaaaggtcacaggaaagggaccaaagtttccattctgtgaaagcccactctgtactctacactgtttccaacccctgcaagagttcagcaaagtgggtgatgtggttcccatacttcagatggggaaactgagccccagagtcaggattcaacacaactgatttcactttgtttctccaaattgtgtcaggccaaaatgaatgacccccaatagcatcatctactgcccatgattagggctgaaacagagattggccatgagctggacatgggacaatgggtacccagccaggttctgggctgtcagcaacatgaccctgccaccaggccggaactgagtcaagctgcagctggaccagaacaggctgagagctagggctgcaggccctggactgggaacaaggacctcaggagcatcagagggagggacacctggctctacccaccccaatgcctggagcagaaagaggaagtaatcaggcctagcaccaccaaagtgtggggttgaggctgagaacagctcctcttcttccccttcctcaagcctgggtcataactgagttttatggttctgccttttttctttgttgtgtgtgacacctccccacacaggtcagggtgacacatagtaatacagtctccctacagatgagaacatgaacactgagggactgcctggatcccgcggctggctttgggtggggtggaaccaggcccggagcccagactgtcaacttctgtcctgtctcgattccgtggccctagtcctccctgcctgtactcctggctcctttctggggctgactggacaatggtctgagttaaagtccaccactctgtccaattcagactccatgaaggaagctgcctggtggcatctggcacaggcacagcccctgtccaagcatctgcaaccctttagaggctgaagagtcccagcatccaggtcagtatcctctagtcattgacagaatgcagccctgccaaggtggcctggagccaaggcttccatgtcccagccagccacagtggcccctgaccttcagacaaaaagccaaggctctctaagaggaggaggcactcccacctgcgtccgcactgctgctccaccctgaaaatgccgagtaacaaatgggactggatttgaacggtgttgttaaatagcgcttcacaaagcactctcccatgcgctcctcatcccatcctcacaacagctcagcagagctggaataaaggccccatgttctagatgagaagatcgagacccaggaaggtcacagggctggccaaagacacaccaagaaaaaaggtcatggccgagacttgaccccagtttttctgactctgagctctggtcttcgtcaatctctcgcctgctgcccagatgtgaatctatctgtgctcctccagccaaaggaccgggatggtttccagattcacatgcacatgaggaaaaacatctggatagtttagaacttctcaggtccacagcagtgcaggtcagcctgaagggccgggggctgggggaagctcattgtcaccagaagatgcttcagatctgttctctcctgtctgaccctcctggcccgggttgaaccatcctccctatgtcagccaaactggaagtgcaccctggaggcccagccaatgtttctctgggtaccaagtcactcctgggcagcaagaaacagaggccttctcggccacagcagactcttactctgtctagaaaatgacacccccagcctagacccacaagggtgaagaccacaccattcacaaaaagcagactccttggtggagtttggtgcagcatatgtgggggtacacaaggcaggtctgcctcactgaagggatgaactgagtggcccaagttcagaaaggacaagagacacaaaaggcagagcaatgcatcaggggctctcccggtccgatggtgctcagtgagggtcccgaatacggcagcctcgctcaacatgaagccctatgtttgcctctgggatccccactttgaagacaacttaacagttattcgaaagccacagggcggcctcgcagtttcctctcccatttgggtccaaaccagaagagaagagccacgatcttgggcaccgtcttgtaaaatcacccaagtagctgctaagggagtgggttttgggggtggggatgggctcggctcagagcaaggccaaaggatcagccgctgcatgaaggggtgaggtgggggcacctacctggacttcacgtgtgtggtaggcgatgatcaagcccaaaaggatgatggtggacagactgataaggcatttcagggccaacgaaaacatggagtcctgcaggaacaatggagagagagaattagggagtgcggggaaaggagcgtctcactttattctgcggctgtgtaaaagagaaggggtggggacacaggagggactgttaccagcccctcctaggagcaggtgtagcacaaagtcagcctgagccccacaaaagccttgggctgtgcccgggccggctctgtctcagcagctgccccctttgagcctctgttttctcgggctaagtcgtatttgcattcctgggatgaacgctacttgggcatgatgtattatgtttgttatacacggctagattcagtttgctgatgtgttatttagaatttgtgcttccatgctcataactcatatgaacgtcattctttgttgtgccgctattacatggtttgggcatcaatattacgccagcttgggcctctgttttctcttaaacccaaaccagaggatttcggaggcagaattctttcaggaatgaatttgaatgtcccggcagctgctctcatctcctggcttaggccaagggcaggggagggaggcagggacggcagaggagctactggagagagaagccaggaagcacaggagcagagaggggtcctggcaggagaagtaccctgatggtccctcctgctagggattaggtgggggaggtgagccccgtggcctccactgcagcctttcagtcccagggcagcttagagaaaccgagaagtgtggttaagggcatgacctccggggccagactgctgggtcccagccctgcgacagccatttagggctacctgaccttggaacgcccactccacctctctgcaccagcatgcctcctgtgtcagatggagataatattctggactacctcacagggctgttgtgaaaataaaggagttaatgtatgcaaagtgcccagaacagtgcctggccaagtaagtgttaactacccttatcatttactttgcatcctctacaaatcagggtgtctgggttggaacttggtgcacctctgggcatttcgaagctggaagtagagatagctcctagttccaaaggaaggcgggaacacagccctgagcaaaggcagcagatgagatccaggaagcatttccaagcagtgactgtgtgtatggcggccctgcacttggtcctgagtggtgcacgccacaaaagaaacattcccttcctcagggagctggtcattagaagaatgatgcctgatttctggaaggcaccttacagtttacaaggtggtttcacgtatttgttctcatccatcctcacaacagccctcggccttttaccttatagatattacaggctgaggcccagaggagggtgggtggcttgtgccagaattcaaagtcaaggcctctgactcgcagtacagagcactgcccacaagccctcaggcacactctccaatgggaaacaacttagaaacatgggaagcatccatttaaatagacctaaatgacatcttaagacaacaaggtaaggtagagtatgatcaattgccagagtgaaacctacagtagagctaggggagctcaaaggagggaggccactgtggatgggtcagagacagctttcagaggcagatgtgaggagcagctgagatctgtggggtgaggcggtatgtccaatatggcaaccacaagaatgagaggagggcttgggactcgaacccaggacttccaagtgcccaggtccatgctctcggccccactctgtgtgctgagatggaatgaaagtgctctccctgatgtctattaatctccccattcatttaattggtacagttcttgaggcccactggagatacaaagaaaactaataaagtaactaattcattcactctttcacaaaaatttcaaccacttctcatttgctgagcacttgctagatatccaacagtgtgctagattctatatatacagtgatatacaccagaagcttctgatctggcttattcactaactctgactttctacattgcatggggtcgtccaactatgggaaaaggtctccattatttgctatgcataagatgatctacacataagccagtcttcttttagcctcttcatgttccacagttccataagagcagcctgcaatcatttactcagcacacatgtatgggggcctaaggagggctggtgctgttctggtccaacataagcacagagaaggacagaacacagtgctggccctcaaaaatattttgatcttcacaagcacttcctggtgcctgaaatgctacccaaccacaagacccagatggggctgaaaagagcaaatggtgaattcaggaacactcagactgtattagggtaaaacaaacctccctacatcaatcaactggggatcaactggggacagctcacaatgttttccatccagaaatgaccataactttcttttcaaaggggtctgaaagcatctgggagcatcacacctccccgggaaggatttgggatcagctgcacatttcagccccttatttatttcttttggcagcaatgaattgacatcagaatccaagtctatttccatcattttaaaggaagcagtgaagggaaaggggccagatgctctctcctttgggcctcttccttttgtcctaaagctcaaaacctttacatgaacaggcaactcccacctgcttcttggttttggccagtacaacctccctggccagctccagccctgtgggatgaccaagctgtgtgctggatcaacagggactctcgatatcttacagatttctttgcattctccatcgcatgtcaataaaaaaaattaaccaaccgcttttaatagctggaaaacatgtcaaagaagtctggctgaactaggaatgttttctatttggtaaaatgttgaattagcatcttctctttgctgcctgaacatcagtgaagcttgaaattgatatggttccttgggggatggcagtgacaccgggctgccatacatcccaggatagggtacctgccacacgcattgcccccactcactcctatctgaggaccaataaggggcttgtagaacagagggaatccagcggtcaactggtcaacccttctgccccgtgactcagaacttttcaacacagagtaacaatccttaacacacaggaatgcttaggaattatatcccatttgatgagaatcatttttttttttttttttttgagacagagtcttgctctgtctcccagactggagtgcagtggcacgatctcagctcactgcaagctctgcctgccgggttcatgccattctcctgcctcagtctccccagcagctgggactacaggcgcccgccactacacccggctaatttttttgtatttttagtagagatggggtttcaccgtgttagccaggatggtctcgatctcctggcctcaagtgatccacccgcctcggcctcccaaagtgctgggattacaggcgtgagccaccgcgcccagctgagagtcatgttttaaagtcatttattcctaaatgcccacaaattttcaagtggttaagtagatttgagatcaggcagtgatggaacactacgcagccactaaaaacacttctgcacacggccgtaatcccagcactttgggaggccgaggtgggcagatcacgaggtcaggagatcgagaccatcctggctaacacagtgaaacctcatctctactaaaaacacaaaaaattagcgggacgtggtggcaggcgcctgtagtcccagctactcgggagactgaggcaggagaacggcatgaacccgggaggcggagcttgcagtgagccgagacagtgccactgcactccagcctgggtgaagagcgagactccatcttaaaaaaaaacaaaaacaaaaacaaaaacaaaaacaaaaacaaaaaaaaccaaaaaacacttctgcagacaatatctgaagacatggagaatggttgatgatagactattaagtgataaactcagaccccaaaacgatatgtagtatatttccaattatttcatttttaagcttttttagtgtagaaaaagactgaaaatatgtcaatagaattcctaagagctgcctccatccatgtggtccctgttctgctccaggccacgagccagcccttcacagatctgtgatttctcattgatgacaataatctgtaataaagcacatctataggggcctaccatgcaaggatggcattgtcaacccactcttacagaggagaaagcttaagctctcagaagttaggtaacttgtccaagggcatgttacctaacttctcaccatggcaaagccaggatttgcaaaagccaggttttacacccagatctgtctgcctccaggttccattgccccgcctgtgtcccagcaccccacctgctctggcggccacgccttgctggccctccaatatctgcagcgaggcttcttagagctgttccagcctttcctcccctgaggctgtgcagagggtgatggagtgtgttccccagcttctgagccagccacataaattgctctcctggcctgccttgtagcttccaaaaacaggccagaactgtaatgattatggtatatcttcccagagactttgaagttctaaatgtattttattgtttgggtcatcgcaaaaaggagaaagctatgcttacagacagagacctggaggggcactgaaccaaactgaaatattagcttaactgagataatgatgcgcaggctccttccccaaccaagctgttacccacaaagagtatatgtgtatggttgtgtgtgtgtgtgtttatacacatatgtggtccattcacgatttctgtcactggctgaaacccccaaagggaaaaggtgatagtatctgaagttcataatttctgaattaaggtctgatgtgcctgcctgacatcactatgttttgtgcattcaatctgggaaataattgatttagaaatcttttctatctaataaggtcaacttttccttcaatttcatggagaggctccaaaattgattgatattcaacatcggcttatgactgtggttctgtaatggttgtcctaattagatactcttgctaattaatgctatgcaaattaaaccagcccctcttccgctaaagggaagaccgcatcactggtcgctgttctccatggagacctgaggcttctttccctccacatcagcaccaagccctggccttcctcattcctcaatctcacactgtccagttcttgggatctttcattcttacccatcatcctcagctcctatcttagcacagcctcctcctcccaggtgcagcaccctaatttaattgcaagcccaggcgtggtggctcacgcctgtaagtccaacactttgggaggccaaggcaggtggatcacttgaggtcgggagctcaagaccggcctggccatcatggtgaaaccccatctctactaaaaatacaaaaattagctgggcatggtggtgcaagcctgtagtctcagcttctcaggaggctgaggcaggagaatggcttgaacccaggaggcagaagttgcagtgaaccgagatcacaccactgcactccagcctgggagacagagcaagactctgtctcaataataataataataataacaacaacaataataataataattgcagctgttggccctcccagcatcctcagagcggcttcccaacctggctcctaccagaagtcagctaacagaatcctgtttcagtcactaatgaatgaagtgacagaatgaagtcactcagaccctctctctcccaggactgtccaacctgagaccgggagagacagccgatgctgtcacagtgggaagggagactctggggactccagagggcagctggacctctgaccagcctgagaagggagaagggcctgatacttgctagccaagacagctctggaacagaggcccagggtgtgcatccgagggcgcaggagtctcagcctcctccatagtgaatgcctggcctggacaagttgcttccttctcctaagcctcagcccccagtaaaatgagactcctggacagaaccttctccgaagttcagttaagcctgatgaccaaggcgccgagcacacatgccatgacaaacaggtcatagggacatgtccaacactcattcctttttttttttttcttaggagttttcttttcccaggcatttctgtgatgaaatgttgggtgtgaaacggtcagccacaaaacccactcacaccatcttctcctcaaacacaacaaggcaagcttcctatttttagtcatgggggggctaacgaagatgttccttgtctctttctaaataacataggatttgaaaccaaaaggccagagttcaagtcatgtctttgctactaactagctgtgtgacactggatcggtcctttaacctctctgggcctctggtttcttctctgcaaacaagaactacccttacttttctcacagctgttaggggatgagatgagatcatgcatacgaaaaatctcattctgttttcacacaaagagaagcatgcattcccttgtagtcaaacaccccttctcttgccatacagatgtcagtgcaggtaaatgcagctgatcctcagtccggagctgctcactgcacccccaatatcagcattttatggctgcaataatttataaagatatccctgaggcatttcagaaagacacctttgcaatccgcatagccaaacattcattcacttgtgcattcatacaacatatattcactgagcacttaccatgcccaggcactgtgctgggcaattgccaaatgccagggattccccacccgctccaaccccaacctgctgagcctgaatcccatccaggagctcccaggagctcatcccaagggctgccctctgcaccatcatcgccccgtcaccttgacatcccatcctgtccctcttggacactctccctggcctctctgtcctgcccacagtgcaaggtcaagaagagatgggccaagggtcaggtcagggggccctggaggacacatcaggctgggacagccaggaatgggcaggaagcccaggctgagggagaaaacccacaagtggttcctttgcgctcgagtgaccagctctctccacggcagagctcaagaatggatattagaggccaagctccaggaacctttcctgcctgcctgagcccactgtgtgggtgaggacatctttaccacaggtcccaggggctggagatggggctaaacctcactgccaccttttctccagcccagtcaccttcttacatgaagcttctgttctgggcccacccctcaaccccacagccaggggatgcttgaggtggatccccagtgggcggaaagctgagacaagaccatccacactctcctctcagtcccaggagccagccaggcatcatgagccagctgacccgcatcaggatgcggggtctgacctagacccgagagcaggtggctcctcagagccctgtcttcagtcctcctgtgccctcctcagcccccatccctgaacggggtccatatacccaccatcgaagctgggagccattacctgctttaatagtacacagggtaacctcagcaccaggaaccccgctggtctgccctgggccccacacccttcccgaggctggccatgcctggtgtctcccattggcactgcccagctggggtgaccagagcacctttcaccatctgaccccattttcccactgatgttgttctcacacccccaccagagtgtcaaccccagagggcagggaatttttacattgcatttgttcactcctagagccccatgcctagaacactggtctggcacatagtaagtcaataaatattagttgaacgttgaatatttgaaggaagggagcaaaatttttgagatatgtcaagcaggtagacacttccatcctgaatttccaaattcatcaaaactaaagagaggtgatgaaagtaacagctaacatttattattcacttaccagaggccaggtactgtgctaatttcgttaggtcctcagaacaacccatggccccattctagagatgagggatctgaagcctggagagggtcacattcccaccgtccctggatgaggaagaggtgggggctagattcaaacctgtgctctcaccactgatccagagggaacctcaggaagacaggatggcaattgccagaacatcacccttgcaggccctgcccttaccggtcccacctgctctctgaagaagcccccagttgtgtggctttagtggtgtgatagatggtgaacagactgagctcagggcttggggtcttcaccgtctctgcagactgggcccggcacggggaaactaggcagataatacttgtggcgtgaaggaagccagtggtctcgacacaaaactcataaagtcaagttgccctggagcatttccctggatctctacgttgccactcccagaaggagacggaacctgatgtctgagggacatcatgcagttaataacaagggcattcaggtctgagcagagggtggcctactaatttttagtgaagccagcatgatgaccaggacaccaattaagagaaaatgatcctccccaggccctggctctcccattgtgtgatgtcccaaggaaggcagaaaaaggtcatttaggagaccacgctcccaaaatatcaagtcagacggggcaccccttcaggccacaaacataattccaattaaggagatggtttcctttataaggtctgggcagaggggaactggcatatcatgaattctctactgcatgcttgcttataatttattttcctgccccacttacaatattggcaaagattccatgcgattcaatcaaactttttattacatgtttgccatgtgccaggcactgtgcgggaggtggaaacatacaggatgaggcctttttaaaggcagtttggtccttgctgctcctaaggtagccaaaagctggcccacctaggattcttgcagacacaaagcaagcacttaacaagtgtttcttgggtaaatgaatatggaacggtaaatacagacttaaacctttgggctccatacaaaggcagaatgggagcagaagggtttgtaactccccacccctacagggaggatggaggtgggatggaagcccatcaagcaccaatagcccgggtccttgtagaactgaggggcttggcaccaccccagagcaattaaattggaatctctgcaagtgaggtctctgcactaacttttaaaaaaagatctcagtgaatctaatgtgcgggccagaaatgagaattgctgttctggggcacaaagaaagaagccaggaggctggggttgccctcacagctctgagacactgtgaaacagacagtcatacacacaagcaatggagcttagaagccatctagttcagtgccccatgagtctcctaagatttctggcacatggccatccagtctctgcttgattttctccaggggttggaaactcacttcctctcaatgtagccctggagagactctattttggatggctctttttcaaagatctgcctgcagtgcttggtcccagtgaaacaaatgcctctgtgaagacctgctctgactttagcatcccggtgtctatgtcaatgactttgacaagtgagcctctccctgggacacacactcattaacgtacagaacaccaggagatcagctagttccccaaccctcattctccacgatgacactgaggctgccttgcccccatcatacagcatcctggcttggagaaaactttagaacccaggtgttggggctcccggcctatgcttacaggggcaggcagcccggcccaccctgcttttcatactaacggaaatataacaaccggtccctgaattcatctgttctccaaaagcctgtatccctatcctggaagtcacctccaagactgtcacttagtcactgtttccttctccaataaaaaaatgggctcctgatgagcttttagcctcctctgcttgtggaatgtgagtgctcttggccagttagcaattacattactcttgtggtgtcaagaagtccctacagcctcctctggctttgatgaatgcgtacctgccactatgcatcaggttctgaaggtcctgacaccatacctttatctcaggagaactgtatagcatactgaaggttcctagtcccagcccccagatctgtcctggcatccagggtgtacagagttacagtgaaacacttaacctttattcaccctcctagcgcctcccagaacgctggtcaatttgccatcaccatgaggggttcacctagcaaatatttactgctccacctgccaaggatctggcccccatatttcatccagattgcaggaacccccattttcttaaatgttctagaatatttgaaacaaataattgtgctttctggatggcttgctttgaagtagttttgctttctcttagtaaaacctatctggctcccaaatgaataaaacagcaggaaatcactttgctctacagaaagctgtgggctccctgttagactgggttgctgactagaaccaaaccagcctagctgggcttgtcccaggcctgggcttccctttccccatcctgccccagccatcgctgacaagacgcacaacagattcccagattctctgcaggagctgtggtcagctaattacagggaactggctacattcatttcagatggctataacttgaaataatgttgattttcatcacctgatagccacagagaggtatgtgggttttaaagacacaaagcaaggcctacagacaactccccaccctgggtctctcagccttatcacccctccaattggccttccccctttcctccctccagcccttgcctctgtctgcaccagaagctgctgcaacactagggccccagctgaaccttccaacttcgtcagagaattccaaaatggagaaaaccactactacccacctgatgctcagaggcaaacccatttccatccccacactgggcaaaatcatcccccaaccccggcaatgtttgggccaaatgaaaatttttaagacacccagaaatcacatatggtgagaaaaacaaccgcctgcaggctccacagacatctctggaggctgttctggagtttcccagataaagaacagcctcgtccgtgtttcccagccatgcttccaggcttcccggagttgccagcattctgagggcagcatcaccttccttccatttccacacccacggccttgccaacaaacgtgagacagtgagtcctccacccaacactcgacttagctggaagaggccttctaagccatcaagtctgactccccgattctataggcaagcaaattaaggcccagagagggactctggcctacccaaggccacacaccagtaacagaaagggctgataatgccctaagccttccaagggtggggctggtgttctgccacatcctcactctgcccatccaccagcttgaacactgtctgaaagggacaggcccctgtcttagtcctctctccacccctctgcagctactcaattcaggtttggggagtgaacatttcctccatgcctcattcaaggacaaatcaggagaaacaataattacctactccaggttctctatcttcttttggcttaacaatacaaaagcttaaacataaataaagggaaatggtctggaaaaataaaaaccagttggcatggaactattggcatctcagtgcggcataagaagtagaaatgctgtttttcagaaacagcacagccgtgagtttcctaacatttggcacaggtttttcaattgtttggatgtgatggacgatgttgatagaagtggtggagaccaaacacaggctattaatagaccaaacatggcacttgtataattctttctctctctcactagctctctggcaccagactgctgccaacctgcctaccttttactttgaggtgccatgaattccagcaatggggcacgacacgagccccactgcctgcccatgtccaagcatgttcatctgagagcctggaggaaggctggaagccacacaccaacgtgggccaccagcctgtacagggcttcaaggaaactgcaagatgcaaagactccttgggtgctggtcctgcctatcacggggcatgcagtagagtctcccaagtagactatccatggtctagggggggtcagggaacctcccaattcctccatgtggttatttcctccatttctttctccaagaacatgaggcagccccatctcaaggcgggagctcattccacactaattgattcaagttagagccatttcaaggcagaaggatctccatggttcccctacaggtgttgcctctaggaactctccacagattcaaactctacaaggacttactgagtacctgttatatgacaggctctgagtctacccatccatcttcatataaactctcacttaatcctcacaggaaggaactgtccccacttgacaaatgagaaactgaggcacggaatgattatacaatttgccaagatcacacagctgaactgtgggagccagacttgaaacacacagcttctgattccaagcccaggattggtaaggaccgcagcacagtcccggctgagacctacaccctgagctcttcacggaggaggtcgcttgttcctgctccactgaagccagatttgctacttctttccccctgagctgcacttgtttccacatccccagaactcccggtcctgaccagctgtcctctacctgcatggggtcagccaccgaggaagccaggccaaagactagagctggaccgtttgacaccatcaccatctttaacatctattcaatgagactaaaaaatcctttcttccttccagggttgttgtgaggaagagcagataatgaacgtgaaaatactctcccagtcgagggttcccacgggcttaaaacagcctatgcagagggtggcgatacattcgggtttacccaggagagtccagtgtatgcctgttatctggcataattattactatgaatggtaatcattaatataataatctcaaaagtgtcccagtttagacaatgaatcatatgatcaccctatatatgtagtatttgctgccaaagggtctgagagaattggggcccccttcccgccctctgcccccacacctgccagcttccacacccactatgtgcactccattagcagacactttgccaggctcatgggcagacatcattctgctggatcaaagcaattgttagtagacagtatttttagcaaggtggtgtcacagtgcctggattaattgcaattaattatatgtcactcctttaaggtttatttcatcaattatggacaatcacggccatgtgccttgcttgctttaacccttggtgacttgaatttcttggcacagaggaggctgtaaccatggaaaaggctgaatatcagaatatatttgctactgagtcactgtgtcctggatgtcagtttagggctttcctgtttacaaagcattttcttgcacagtttcctatttgatgctgggaggtagagaggaccactcctaacccacagatggaaaaactaaggctgggaggatttaagcaattacccaaagccatacagttaggaaaccccactcttctaacacagggttgccaaaacatttccaagtcttctgtatagactgatgagtgtgaccctctggcatcagtggtcagatagccccatggccaggcatggggacaggatctgagggcgtctggaggcagacttgccagggaggagccaaaggcacctgacgcatgtctgccaggcagagcagcccttaccttgagcatttcaagtggccctaatgtcaagaaactccaagaagaatgtgtccgtgccagaaaaatatgcaaacaaggacacccagcaccttccttctttgagtgttgagcagccggaagagcagccagaaggtacctcgtacaagtgaggagatggtaggactcccacagtacccctgggtccctcttgctgttgtaataggaggagccagaggaacaccccacctgatactcgactggccttaatttgggctcctgccccccgtctattttgccctgcaccggttacagaatattagttctaaacagatctctgagctcccctagtccaaagcctcgttttacagatggagagactgagaccccaagcagggaatgccccatctccgaccccacttgccagggcagagctgagcagggacgtgggcctcccctcctgtgggttcttgctgactgtggctgggagtctcagctgggaactggggtgctgtctggagcgtttctctcacgggaaagtttgctgcgtcttttcttccatccctctttcttacctccacccttgtctcactctcctcacccacatttcatccctctcgcactattcctgttttccgggaccaggctttaagattgtcagctaaaggggctaggtctgaaggaaactcggctggagcccgagagccgccgcccctgggctccctctgagtggcccctccaggctcagggctgcttcatggcacagtcggggtcctttctgtctctctgctccatcacctcacagaggacttggcacacagtaggcactcaataaatacttgatgaatgaatgaagggatgctaccctatggcctgttcccaagaagaggagaatcgtgcaaaatcacttccctgcaggccccatcatctaggtggggaacaacacttccaattgtggggagaactccatcaacttttgtttcctcgttccactgactaaacagatacttatttgcttagaacccattgtttaagcctttttttttttttgagacagagtcttgctctgttgctgggctggagtgcagtggcacaatctcagctcactgcaatctctgcctcccagattcaagcaattcccctgcctcagcctcctgaatagctgggattacaggcgcacgccaccaccatgcccggctagttttttgtttgtttgtttgtttttcattttttgtgtttttcttttttttgcattttagtagaaacagagtttgaccatgttggccaggatggtctcgatctcctgagctcgtaatccacccgcctcggcctcccaatgtgctgggattacaggcatgagccaccgcgcccagcctatctacatgtaacagctgtgatcaaagacctaggaaaacagccaacccagccaactcctcctcctggttcctcaccctggaggagctctgggcccgagagcacagaagctaggaaggcagcagaacgagtgatgcttatgggggaaaacctggctttccacccacagctgtttcaaggcgtcctgcagaagtgggtctgggggtccctgggcaggaagagccagtctggggctcccaggcatccactgccggtgatgacacactgagctatcaaagcttgggtcagagcaaaggaaaaagctcacaccagccaaatgcacagacatctcacagatgtcacgggctaccaggtggcaaccccgaagcagctgcctcttgtcacgtgggggccaggtgggtggggattttggcccaagggggtgaactgtctcactgaagagacacagctgggcccagccagggctgtgtgccgtggggagccaggtgtgctgaggtcagcggggaggaaggcgctctcgcagggctggaagaggagaagccaggcaggcctgaattacgagggcaggagtgcacatgcttcctggaggactcacccctctccctccagctgccaccagctgctgaccacggtgggacagccagctgacaggggtcaggcggccagaggtggatggacaagtacagaacagagagtgtgggggccaaacaggaaggcggccacgggtgtggagaacgtcagggctaagacagaccttagagtctttgcatcttacaggtcaggaccctgaggcctcgacttggccaaagtcacccagctgctagatccagatctagaatttagagctagagcctagctccttcccctactcccgggctccttctgctataccatgtagattccatagcaagtaatttaagacacaaatcgtgccatcccactccttaaatcccttctgcggctccccacagcctctgggatgaaggcagaccccctaagcaaggcatgatctgacccctgcctgcctctacagccccatatctcatactcacaccataaattctagccataccgagttgctcacactccttcaaaatgcactaagctttcgtttccctcaacctttccatgtgcttgctgggccgggaacaacctccctgccttagcctttcccgttcccagtcaaccttcaggaccggctccgttctcgccactcccaccaccctaccctccagagctgcctccgcctctgcgcttcctccaccctgtcccttcaggcctcttcgggagacaattctaagtgcgttgagcatctgcttaccaggctgtgagctctttgagtgtgggaaccaagtctttgtcatctttctgtttctcccccacccccagcaccttgcacagtgcctggaatgtgagaaaaactccattaatgtttgtggaattaattatcaaattaaggagtgaatgaagcctgggcagctttgacagtaccttgtttctcccgaagctactttacctacagaagggccagtgccactcaggacatctctaaccgctgatctgccttctgctctccctccctccccatgttggagggcagtcgggtcactccatgggaaaaacagcaactgagatacaggggacccaagtaacacccccagttgtggtgctgacacaggtcgctgtgtagcgatggcaaagcagctgagatggtgactgagttcacttatccatgaaatgagtgcataaccacgtgcccaccaccatcgagtgacctgcgatctgcagacctcaggaagcagggcgcagttgtgctccctccacccccatcactgctccaaggctctgcgtacctacaccagaaggggaacagatcccatagcccaaaggagcactgagcctccaggagaccctttggaggctctggtaatgtgattttagagaccatctgtcttccaaattctgttttccctgtacaaaatacaaacaagatacgacacctgatttacatcccctaagcaccaccagctgatagggaggaaaggtccccatgcagtgagacagcagcagggacgaacgtgacctgggtttggaaaagacactacaggcaatccacaaagtggataatccacacctggctgacgaaggtttggcccaggcacagagagtgctccacagtgagtgagggttgctggactcagacccccgctcagctctcactcgacaaggctgaggacctcgcctggggcagactcggccacagagcatctgagcctttctaaagcagtcctcagccacccccaagagcccttctgggggccctggccactggccactggtggaagtgttttgaatgatggagcgcagagacaaacacagacgggacaaggtgccaggagccacataccagagctgcttctcagagctgcaaatggctctcagatgacaccccagctgctagctccttgccaggggcagggtgggcagagaggcctgcagagcaggggctaggtcacagagctggggggaggggcacagggagtcagggatttctaagactcagactgggaacctagcaggaaaggcactggaaattgtacttactccatttggtttgtctatttgtctcttgcaatttatctagtatttcctaaaaggtcactgggtggtgatttcaataatgtaaaatttgtagagatgctctaaaagaaatgtacaaatttcacaggtttacactggcttaaaagcaatatattttattaaaagtgtctattctaagtgcactttggataggatttggagactgattggttagagattcaaaaggccttgtgctattaaaagatccactgtgtttttggggtggtaaaaagaaatagaaatcaaagcatttgcaaaggtatggttggtggatggagaaaaagcggcgtgtgagatcacaaaatcctttgtcacctcacagtccccgaagcagggagctgggaaagaaagatgcttattacaagcagagggccaggtttcctgcgaaggcttccgtgtcccaaaatctcacaagccgcttctcactttcctctcaccgctcctcattaactgaagccaatccttgtcattcaaaggaaaataaacagggagcaactgcctgcagagacaaagagtcctcatatcgggacaaaacggcttctccaagcagacaccttttccctcagccccagtcagaattctctatttctttccaaacagcagagccatttccttcctgtcagcccagtgatgcacaacttcctgtcaggacagctgaggaatctggagaaatgtgtcttccctcacagcctctgctcaggtttgcagggcctcagacagtaccagggagcagagtggagagctccaaagaagcagcccctcccacgcctctgcccccaccaacgccctccccggatcccccaggtcaggccaccgaatccagactgagtgtgtgcaccgcaccctgccatcttaggcttctgtctcccagaagcctttgtgggaaccagcatttccattcccaaagccaccaggtggagaccaggggcaggcctgcccctgcggggtcaggccccgacctaatcaggaccctggggcctgtcagaaagactgaggcctgccctagggctgcagagatggtgagggcgcaagggagggtcttttccgggtaaagatgggccgctgacagcccccttaggtcagcactctggcaaacccactgtggtataaaaataaaaacctcagtcccacagactccacattaaatggagtgagaggcagggagatgaacactgaaataatcacctccatttagtaagcgctctccacgtgtctgcattcttcctttaatccccaacaaaccctgggacagtggttcccaaactttgcggcacattagtatcacccagggagctttttaaaatccccacacccaggttgcacctcagggcagtgacatcaggtcagaagctgggagccaggcatcagcatttttttaaagatccccaggggattccaaaatgaagccaagttaggggaccactgagcaaggcactgttcgtacctgttttattaataaggagattgaaactcagagaggttaagtcgcttgcctaaagccacacagcttctaagcaatagaattaggcttctggttcatgcctgttattccatcacagagcccccctcactccaaactttctgcagaaagttgttcagctctatctaccaggtattgtctccctactacatccccatccccgaatgagagcacctgcagacatctttgcttgctagcaggagtaaggatgagatgtgcgagccgaaggggctgtgcagggctggggagagcgggctgagtgtgtgcagatggcctattgggaggtcatgggatcggcaggttctgctccttcctcatctgacaatgccatttaagttctctccagagcaaagccttggcctggcctaagaggatggccaggtgtgaaggaaacgcacgcgagagtgtagccacgtgggtgagcgagggcacgacagaggtggtgaggatggcacacagcctggagagggcgagcccagggtaaggggtgaggggagacccccgggagtgctccaaaccagaaccttgggggattgacccacttcttgctgcctgtgtgacttgcagcaaatcacttccagtcactgggcctcagatcccctctttgccctgcaatggggtgggaccctatggtccagagggttctcccaccctggcctccacagtgatcatggcggcccccttcttgggtgtgagcaggtgcgggtgtgggagcagctgtggcctcatcccaggcagggtccacacacagttcaggcacccacagagccctggctctcagagctgtctggccaagacagggaggccagtgcacctattgaacatacaggccgaggagaggggccctggggcagcaccccacacttgaccttcctgagtgtcccagccatgacctcctgagcttcacatcacctggtcgcaccccaaaagtggggcagaagggggctataagcaactgggatttaaagcccctacccctcaccccagcccactgacctgcagcctccactggctgcttccctaagtgccagacagaatctggtttccctcctgtggctcattcagggaccccccccccgccaccacctcctctgtgagctttccccggccctccctgacataattaaatgctcagtgctacttctgtgcctggttccaacctctccccttgcatatattacactacactgtgctcaccatctgtttacactgctgttaccatcagggcctcaagggaagagtccggtttgactcaacagaggcagcaaagcatcacggtctgcagaaggggctttggagtccgaagacctcacttagagccccactttgccacttcctcgccatgtgaccaagcctcaacttactcatctataaaatggggcagtaagagtagtgacctcataaagttgtcatacacattacatgagatgacacgtgtaaataagtggcttagcgaaggacctgacacttataataggagctcaataaatgacagctatgagtgccttcatatctctgacacctagggcctagcacaagcccagcccatagacatagatgctgaagaagtatgttgaaataagctgaaccccagcctgtttgtagccttgacggtctgcttggcctctccaggagctagatatggtccctgcccctcccacctcccaaccagggctggctccctgcatccatccaccctgcagaacagttcccctccccagaacaagaagctgccccatccaggttctagacaaaaaagccagctgcctggctctccacagctggttcccagcgtcccttcagcttgagagcccacatccccgggcttccaggcagcacccactgagctcaagcctcaagtatcctcagtcccagcctcagccctcatcaaatattttttttaatagagatggggtctggctatgttgtcctggcctcaagcaagtctcccacctcggcctcccaaagtgcagggattacaagtgtgagccactgcgcccggcccctcatcaaatctgaagtcccaaggttagcgagtatgcagggaggctgggagagaaaagcaagaggccccttacagcagaggctgaaaccttttaaagcaacagtgagaaacgctgagagagaaaccaggcggggtaggtggggagttctctcccggagactccttctcacccttgcttcccacagaacccaagaaaaaggcacttggcaatagttacaattccagacggcacttaacgaagtccaatgcctcagcaagacagacgtttggagaaataatgacccaggggactttcagggaaggctgtctggacatggaggggcggctgtgagatttaatgaagccagttctacacaagagtccagcacagggtgcggtgcccctgcctcggtgactgccccgaaagtaggagggggggctgcacagccaggccacaaagggcagacaccaggccagcaggggaaggccaaagaacacaccctcgggaccagcaggggcttgcagaaggggactccacccaagggagcaaatgaatgtcccccgttacacacagatctgggcagacgccctcaccctcactccttcccctccccaaccctcctccagcccctccattatgcaaatcaagtgactacacagatttgcataattcatgcattattagtacgcgttcttgtcaggcttttagactttataaagcaattttgctacctttaatggagagtaagagacaaggttctagagagagattttctgtccttctttcattagacatgaaaacagtctctaaatcttaagccagggagagagtcagacagaaatgaagtgacttagagttggaaacatgaccaaacacctcgttgacacttggtgtcaaaggcctgggtgccgggcatcgcgccggtcacacatcctgtcaggcctctcaggcactcagaccatggagtagtccccagtggggcagacgttattattgggaagtcactccaggttcctgggagactcagtaacaacaaaacccccactctgggtttgtatcgcttttttatattttacaaagggctttcgctctgctatcttactcagcgcccacaataaggctatcgggttggaagggccacatttttaccctcattttagacatgaggaaactagggggccagttgcagtggctcatgcctgtaatcccagcactttgggaggctgaggcgggtggatcacctgaggtcaggagttcaagaccagcctgaccaacatagtgaaaccccgcctctactaaaaacacaaaaattagctgggcatggtggcgggcacctgtagtctcagctacttgggaagctgaggtgggaagatggcttgagcccaggaggtggaggttgcagtgaactgaaattgtgccactgccctccagcctaggcaacacagccagaccccgtctcaaaaaacaaaaaaaagagagagaaaaaaaactggggccactcacctaagatcaaatctaggctctctgtattttttccactacaccagggatggcaaaccccttgccactcttccatttcccctgcccaagatagacctcatgaatcaatcagggcactcttcccattgagctcagacaacacctcagaatccttcccaacacagccctcctggaagctggtaccaattgtttcaacttgacacccagataaaacctatttgctgttcctgcactgtatcctgccaactcctcagcatccagccaacactgtgacagtgccaccagtttctgggaagtgcctgtgggctaagcttagcctggctgctcagccccaggagccccagacagccaccatcagccagctcaccggctccaaatggaaccagatgcacctgcatttgggagcagatcagggagagtgactcctacacccccgggcccaagaggtctctgcttttctcactgcgggggccccactacccaggaccactgaggccaccttgactaatgcacacctgcttcccacacagcaggagccaaaggtgtctgcttctgcaacggacgcagcattgctgtgtggcatggggccctgcaaggggttcagtcagggaaggggccacatgaccagaccacccccgcaaacacacacacacacttccctagggccgtgccccagccagtcccaagggcacacgtccttcccttgtacacatgcggagcctcctcctctagacagatccttctgcatgggccccttccacaaccctgcaaggaaacttgtttagtaaataatagtaataaaaccctaaaagtgctcattttgatcctcacgcacatgcttgttgtccaggctagagaaatgtgaatcctgccttccccaacgccctaccagcccccaagcccatagggcagccctggctcctttcctacccttgtcaagaggccagtcccctttggaagatggcaagcagcctgccggtccaaaacagtggggtggcacagcacccacaccagccaacaccagctggcagcggctgccctggctggggggctttccttctggaacccatcagcgctggcttcctgccaggcccaagggagatgaagtacaccctcttcctgaccacgtctaaagggcctagacgatgcctctcccagccagaacccacagcagttacctccactctcttgccttacccttacttcacagtgtggcaccctccccttcctggtctcctgagccccaaatccatgctgctattgcaatcatcaatgggcttattctccaaatcatcgctggcttcttctgccaggccttgctgagttccttcctgatatttacagcccccgaggctcctttctggaggacgattaggcagcagcatactgagggggagccaggagcgtctgccccccgggaggaggagtgttttatcactgaccttgtttagaagtgccggtacacagcaataacaaaaaccagactttttgttggctttatttatttttctatatcctctacagacagtgtacccctcattgtctgcaccgggagccgattgctcccctgccccttggtaccctactgccattgggtgtctgcagccagtttccatggggctgggtcagatttcagatgaacgagtgaaagaatacacaaaattgagcagagaaagcactggctccagaagctccacttctcgctgtactccacagttggggtaatcaaggcctttggggactgccctctagggatttactgtgcttactagaggaggaatgaaggtttattcagcactctcaggccctggtgctgtgtatccatctagacctatcactatgttgtgaggtaggcattagagcggcccccaaggccaacctcccatcaccaccacccacacatggatgtgaccaaagcaggcaccggactcggagtcttcctgctagtaagcggcagagccaggagttgagccggctccgcctgacccctcacccccctccctgagccctgggctcctcccaggcctgcctccctgaatcctgtctgccccctcccctgcctgccctcacttgtccgccaagcatctaccagggcccctgtgtgccaggcacgtgctgctgctttcacatccctcatctcctggaaccctcctcactacccccccctgccctcggggagcctgcacatctctccaggccacaccgagagggaaggggcagagccagcgtgaatatcaggtcactggccccagatccagggctctttcctctctggagcctgagctgggccggcacccagctggatccctgggcagaggcccagccagccaatgggaaatgccatcacggaggaaggcaccgaggaccacggggagtcaccaatgacacaagcaaagccagaggctgggctggccatgctgacccaagaccccgctctcctgatgccacactggggttgcctgcagggaggctggtgtcttgaaaagttgactctgagatagatattatagtaagggtcatttatgtgaaccacatgattagaagtccctagatttcttctgaatatcctaggattttccccagcccctcaaagccaacacgcccaagatagaattcaccattccaactgcttcccaagtcttcaactcctttaaaggcaaggaggtcttgcctctccccacccatcaagtcaagtccatcatcatatcttgacaattaaaaacagaggccatttattgagctaagaacatgacacctgcgtaattacacctgtgtgatgcccttacagccacccgtgggccaagcatcataatgcccactttacaaacacagacactgaagttcagggagaccaggcaacttgcccaactgcacagccagtcactcccccagctccgacacgaacccgagagtagccggctccagcacgctgctgctgtcctccatacctactcctcccaaatctctgaaaacgagcaggaagagggtgtattccacctcctttgggcctggccagaagccagcgctgatgagttccagaaggaggcctccccccctccccagccagagtggctggtgccggctggtgtgggcaccgtgccatcctgttctctgggaccagaaggctgcctgatgctcgctgcttgtcattctccaagaaaaggctgggctttgagcagagcaatgtggcgagtgggccacgacagtcacttcgagcctcacacacaactcagatacccaggatggagaaaggtgaagcctgacaagctgcctgcctccccagacctccccccatatcttcccttcccactgccccgagctgggttcaagccttcattcctccttttcacaactatcgcagtaacactgcttccagcttcctctctctataacccatcctccatgctgtggctggagcacaccactgccctgctcacataccttccactgttccctgtgcctttagacaaaagtgcaaattcatcagcctagttcgtgaagcccccactactccaccagcttcacgggcagggggctccatgtccctctccagtcttctcttcccagaacttctaggaaaacctacctctccagccctccctaagaacacagggcactctccaactttgagcctctgcccctactgttgcctcggctcagaacacgcattcccttttgcctcatgaagccctaccttccttcaaaacccagctcaacccctacttcttctaagaagcctccaaacattaatatccgcggcaggcccttaacgggatgcagagcctctctaccgcacttagcacagtctgccttgcctcagagttacggcagcccgaacaccccctcagcctcatccatctctgtgtcccccaacgtccccggggccagtgcctgccacagaatgggcatcagtgaaagtttgccgagtagaatgttctcagagcttcaatatattggtacagacctttccccgacagcaaaccccatcttttcctggggctggtcctgagctcagaacaaatgtttgcttcccgaggtggccactggggaatcctggcccactcacctcaagaggattctagcgatgcctgggctggcacacttagctgtttctccccctgccaggaaatctgccactcaaccagctctgtctcccactcacacagcacagaaataatagccctgcattttcctgcaaattccatcttccccaaatggagactagctccacctgttcaaggaaacacaagcaagaagcaagatggagcaggcctgggagaacagccatgtggcctcgcaggggccaatgggggttcctgggcaatgccccccaaggctattattcagtgctggactagaaagcggattggcctgctgcctccctttgccggcacatcacagctgactaagcatgcttcccatccgggttcccactcagtccacaccacagccccattactgtgtagacaccactgccccactcaagacaagatttccaaggatgaaaagacatggagactagaaactaaggaaaaacttcactgaggcatgaggagtcaggacttgaattcaggtctgctgactcctggaccaggctgcttgatgacagaggcagcccccttgggaaagggtgagggaacgagaggacctggaagggcaggctgcagttagaaatgcaggctccattttcgcattcatcctcataacaagctggtgagaatgagtcatcgaaagcagggtttctcagcctcagtaccactgacattgtgggctgggtaattctttgttgtagggggcatccctggcctctccacattaaaggactataatatccctctcctgactgtgacaaccaaaaatgtctccaggcattgctaaaagtcccctgaggagcaaaagtgccccagttgagaagctctgatctaaaggcacagttagatcccaggtcttgtggtaagggaggggaccccccactgttctccctcactcccattctggcaggcgcttctttctcccctactcatgccactcgccaggcatccgcagcccataccagttctactgttccctctgcaccatctccctccactctaggggcagagccaggcggccccacaggcattccttatgttgggcatgtgtcaagtcaccggcctaagctccttcattaacatcacttcacaaaactcctccaaggcaggcaccatcaccccaatgaaacagataaactcaaagattaaatcactgaagtcctgcaaccaacaagggtcagggtccagctttgaaactaagtcagaaggcccatgtccagcaggcctgggctgcccaagtgaggtggccttggtctacaggtcccaagactctcaccctccaagcccgggtgccagcatcagacaccagctgggctaggagaggacctcaaaagccatacctgctgcctttccccactctcctcccagtcttaaaaagaacaggtgcagtggcttccctgtgtggtccgtgagagccctgggccctctgcaggctttggacatttggcgacatggttggtgcacatgaggctggtgattcccaacatccagtgcttaccttcccccagctgggagaccttgaggaggttattccacctctccaagctcattaatcccttcccccaacatccctgtggagttgaaagtgctagaaaattaggaatgcatatctttagcgttttgtatcatttcagtaagtttccataaaatcaggcttccaggccacactgggggagcttctgagcatttatgacacattttattcatcagcccagagcagggagatttgaccttgaaatgtggattgactcagaaagaccctagcaacttccagtgaccttcagggagtcaacacccacggtgctggaggcatggataacttagctgatttttgtttgtttgtttgtttgctttgtttgaggcagagtctcgctctgtcacccaggctggagtgcaatggcactatctcggctcaccacaacctccgccttcccgggttcaagcgattctcctgcctcagcctcccgagtagctgggactacaggcgtgcaccaccatgcccggctaatttttgtattttttgtagagacggggtttcaccatgttggccaggttggtctcaaactcctgacttcgtgatccacccgcctcggcctcccaaagtgctgggattacaggcgtgagccaccgtgcccggccaaattttttttaacgttgccagccatgcctcgaacagacctctggaaggtgagaggagccatctgttctgggtcaggagcccaggcagaagcttgccacggcctcaagcaccatcctgtgacctcttacaacccctggggcaggtgctacacgcattatatggaaattgatacacctcaaacttaacgagtccaaccacaaactccctgtcttcccccaaaaaactgcttctcccacagtcttctccattcaattaacagaaattccatccttccagttgcttgggccaaaagtctcagcctcatccttgacttcccctttctctcaccactgcctgacctgcacaccatgaccttttgtccaattcatcaggaatgccctccttttaaatagcccaagggtccagccactttttaccaactcaatgctaccacccaggtccaaaccatcaccaccctcacctgagctgtccccacagcctctcagcggggctccctgaccctggcttgaccctccctgtctgttccaaacactgcagtcagagtggtcccattaaaatgtaagtcagatcttgtcacttctctactccaagccctcctcttgctcccatctcacccagggtaaaggccacactcctcaggacggtctacaaatccctgcagagccagacccgcctcccctgtgacctcacaaccccgcccacatgatccctccactcactgaatcagcctcacaggcatcctctctgctcccaggcctgcaccgtccagtgtgaggacacgagccacgtgtgtccactgagcccctgcaacatgaccagtgcaactggattttaagtccatttcatttaaaattaaatataaaaagacactccactcttttattggaaaaattttaagtacgttttcaacaacttgagtgtgtgaatctattcttttttttttctcggacggggagtcagggtcttgctctgctgcccaggctggagtgcagaggcacacgcatggctcaccacagcctcaacagcaagctatcccccacctcaacctcccaagtagctagaaccacaggcatatgccacacacccagctaattttttttttttttttttttagagagatagagtctcactgtgttacattacccaggctggactcgaactcctggccttaagcaatccacctgcctctgcctcccaaagtgctgggattacaggtgtcagccaccatgcccagcaagtctgttcttttaattgtaaattttataaactctaaatacagatcaagtatctccaatgaaaacttaatgtctgattgagatatgctgtgtcagagacacaccagatttcaaagacttagtacaaaaaataaagtgtaaaagatctcaataattttttgtattgcttgcacattcaaataataatattctggctatgttgggttaaattaaaaatattattaacatgtataattctacttttctcttttcactatttttaatatggctactcaggaatttaaaatgacagcggtagctcccatttcgtgtccaccggacagtgctgtctacaacacaccaggcatgatcccccctcagggccttcaccttgctattcctcttcccccaggtggctggatccctcaccacttcagatcctccaatagacatcacctttttggtaaggccttccctgagcacttatttaatttatttatttatgtgtttatttttagagacagggtttcacatgtcacccaggctggagcacagtggcgtaatcacagctcactgcatcctcgaattcctgggcttacgggatcttcccaccccagccacccaagtagctaggactacaggtgcacaccaatgtactcagctttttttttttttctgtaaagatgagagtcttgccatgctgtcctggctggtctcaaactcctggcttcaagcaagcctcttgccttggcctcccaaagtgccaggataataggcgtgagctaccatgcctggccctaagcacttctttatttgttttatttgtggtttttgttttctgtttttgtttttgtttttgtttgagaccaggtctcactctattccccaggctggagtgcagtggcacgatcacagctcactacagctttgacctcctgggctcaagcgatcctcccacctcagactcccaagtagctgggaccacaggcacgcaccaccatgcccagctaattttttgttttgtttagaaggcgtctcactatatggcctaggctggtctcaaactcctgagctcaagcgatcctcctgcctcggcctctcaaagtgctagaattacaggcattagccactgcacctagctctgagcatttatttaaaatgaccactctcagccgggcatggtggctcatgcctgtaatcccagcactttgggagggcaaggcaggcagatcacttgaggtcaggggttcaagaccagcctgaccaacatgatgaaacccagtatctactaaaaatacaaaaattaactgggcatggtggtatgtgcctgcaatcccagctactcaggaggctgaggcaggagaatcacttgaatctgggaggcggaagttgcagtgagccgagatcacgccactgcactccagtctgggtgacagagtgagactccgtctcacaaaaaaaaagctgggcgcggtggcttatgcctataatcccagcatctcgggaggccaaggcaggcagatcatgaggtcaggagatcaagaccatcctggctaatatggtgaaaccccgtctctactaaaaatacaaaaaattagccaggtgttgtggcaggcacctgtggtcccagctactcgggaggctgaggcaggaggatagcgtgaacccgggaggcggagcttgcagtgagccgagattgggccactgaactccagcctgggcgacagagcaagactccatctcaaaaataataataataataaattaatttgaaaataaataaaataatatgaccactctcctctcagaagcccctgcactcccatccagagtggtcctaacaattgtgattgttattgatgatgacaatgatgaaaggaaaagagatgtctttttcctgttatctaactctggctgtaaaattagttggggccttaacagattgggatctaagacttgtcaatggagtaagaagttgtatcttggagggaagaggctcttcataacactcatcatagcacttatcaccatcgaacataatatataattaacttagatagtttactatcaggcttatctattaaaatgtaaattcgtgacagcaaagatttttctcttttgtgggttttttctactacagtcatgtgtcccataatgacatttcagtcaaggtcctgtacaattataatggagctgaaaaattcctatcacttcgtgacatcttgatgatcctgaacctgtgtcagcccaggctaacgtgtgtttgtgtctcagtttttaaccaaaaaagattttgtaagtaaaaatgcatctttttaaataaatatttctaaaatggaaaaaaacttatagagtaagaatataaagaaaatactttcgtgcaattgtataatgtgtttgtgttattacaaaagagtataaaaagcttataaagtgaaaaatttggccaagcgcagtggctcatgcctgtcatcccagcactttgagaggccaaggcgggtggatcacttgaggtcaggagtttgagactagcctagcctacatggagaaactttgtctctactaaaaatacaaaaattagccgggtgtgatggcacgtgcctataatcccaggtactcaggaggctgaggcaggagaattctttgaacctgggaggttgaagttgcagtgagccgagatcgtgccactgcactccagcctgggctacagagtgagactctgtctcaaaataaataaataaataaataaataaataaaattatagtaaggtaaggttaacttgttattgaagaaaaaaatattttaaataaatgtagttagcctaagtgaacagtgtttacaaagcctacactagtctacagtcatgtcctaggccctcacattcactctccactcactcactgactcacccacagcaacctccagtcctgcaagctccattcatggtaagtgccctatacaggtgtagtattttgtatccattgtacagtatttctactgtaccttttctatgtttagatacatacttgccattgtgttatgattgcctacagtattcaatacaggcctgggagcagtaggctacaccatacagcctcgtgtgcagaaggccatgccacctagtctgtgtaagtgcactgcatgatgctcacacaatgatgaaattgcctaatgacacatttcttagactgcgtccccgtcgttgcaacgcatgactgtatatctgtgatgcctagaacaatacactggcacataacaggcattcaataactttgtcaaatgaatgaaattatttttccgcctgggctggctactcagctggaagtttctaagtgtctagcatatggtaggtgcttgacagatgcctactgaatgtcaggctgatctgttagcagggtcattggggaaactgaggcagcttagctgagtgatcccacagagagcaaaagcaagcgccaagggtccttgagtcagacgtggtgcctcctcccgctgccacccatgctccctctccccgccctgagggaagctcccctgagcccaacagcctcaggtacctcggggaaaagtacatttcttttcctttccatagacttttattctcccagtgagaagacaaatctgtttcccctccaccagaaggcctcaagccacagctacttacattatagtaattaaatccctgctgctaggagggttcaggagacaagcaggactcgtgccaagggctggcctgcagggaggaggcagcagggagggaggctggccagaagggcctgtctctcagctgtctcctgagagtgagaaaatccccttagccacgatgtcttcacaggctttcgcttgtgggataggaagataacgccccccgcagcccaccctgccaacatgcaccatcgatgaggacccccgccagctggaatagcgtagctttcttccagttctctccgaaattccatctggtgctcacgaccttcccgcagatggccagtgcaggaaacatcccctcctcaggctccttctctcactctctagatgacaaaacagaggaccagaaactaagctgccccacacctagcctaggatgcttctcctcacctgcaactcagctggccttcacagagcgctccatgtgtgccagaaaccatgtcctctgccttacaaacagcaatatctcattaactctcatgacagccccagcggccaggttaggattcacccccatggaaactgtgaatcaaagcactgagacagcttcccaaagccacacagcctacagtaagtgacacagccagcgctgtacccaatatctgcttggcactaaagcctgttctcctaacaccaggctagatagcccatatagaagaatcagaggatggcctgggagacagatatgagggaggatggaagaagtgagggtgagatggaccttcaggaaatggggggaaggggagcagacggaggcgtgggacaccaagtctcaggcttgtgggtcaaacccaagccacatgtgtgtgcccttgtctctcgcaaagctcacatcagacctgttgttacttgttcagtgcctgcctcccccaccagcctgtgagctccatgtctatttggtgctgaacccccagaaccaaccagaacacgccaggcagtgcccttgtctcatttattcctcatgacacccattctcatgagagagagaaaacactgttaaccccattcacagacctggagactgaggctcaaagaggtcagttttctcaacaaggctgcacagccgagaagccacagagctgcggcaagaacactaggacgcatgctgttgagggctcgggtggcccctccagggcccacaggagactttcctcagccccagagcccagcacggcacctggagcttcagcaaacccctgtatctaaactgccagcatcctcctcccctcctccctctacccttaccccactccatgagcacaaaacatcccctgaggctctgggggaggctggcaggggactgagggtggcacagtaaggggtggggtgggcgggagtggagagctcaggcagggcaggagaagctttttggcttgaaagagcccagtctaggatctgatatgcaaaagcatgtctgctgcacaatgtgagggcgtcggagacactcccctgtgtgcaaatccaaactccaccacctcccagctgtgagaccctgagcaagtcacttaaactctcggagccttgggtctgtcatctgtaaaatggggagaattatatctacctcacagggttgttgtgaggacttaatgagatgaggtgtgtaaacacacatagtaggcccttaataaatattctcttctccaccgcctgtcacctcttcactcctgaataagacccggtgttgctttggagtcattcttacggaaggaaaaataagttcccatgtaatgagagcggtgccttcccccaagctgctgtggacacaggctttctttctatatgatcccgtccacccaccaggaaaccctcatgactcaactccatcctagacttgctctcagcttgcatcaatttcatttcactcttaagggatctttccatcgctggcacatagtgtgcaccccgtcaggtgtcttctgccaaaatgccctcccaccaggctcagcaccattactctcccagagcaggggaaagcatcttggcagagcttaacaccaggtccagcccagagcaggaggggctgggaaccatgggcccagctgtgagggaccttgcatgatcccaaggccactgagctctcagaagaaacaaccaaggtaaaacccaccattgcccagcatggacaagagccccctgggtgacagctctggcccacgttgaattcttcacctctccacccacaagaggaattaaaataccacctcccaaataaaggggccgctgcgcaaggccacacagccaaatagccaggatttgaatccaggtctatggggaaagcctgtgctctcttaggaagagttggtggagaacaacacatctggctggggagagacccccctggagtctgtaaggcacagattctctgcactcctgccgcctggagcagggcttgccacacagtgggtgttcaggatatgtttccagaagagggatgggagaaacaaaaagagaggaagaactaaaaccaggaattccaggattccagctatgcccctgccactaacaatgctgagtagcctcggacaagtcatgtaacttttttttttttttttttgagacaaggtgtcactatgttgcccaggctggtcttgaggtcctggactcaaccgatcctcccgcctcagcctcccaaagtgctggattacaggtgtgagccaccgcataacttctatgggccttggggtcctataaggaggaggatggtcctttccctgccttcctcacagggctgggaggcatatgcagggatcttgcccacccaggctagcacacctggctggcctacagagcttggccatctagggcaggtatggtgcccccctgaggaggcctcccctgcatcctccaccaatgccatccagctctgagccctccaaaggcggtggctcaaccctgagcaacatgcctaccccaagccctcaccttgggagaaggtaacatcacccatgcaggcagctccggccattcccatgtatgggagatttttggggagccaacatcttacccactggaagccagaaaagaaagaaaatagctaaactccaattcgttaaaatcagaaatctcaaaaggggttttgctctgcaaaaatcgctgctagtggaagcttgcgaggaggcaggctgatgccaactcaggcaaaggggctaggaggagccaccacttgctggcagcccaggagcacccacagccaggctggccacttgaccaaccactagcaagtgtcatcctccccaggttagtggatgtcagtctccccacatccattacaaacggggacactgaggctcggagagtttgaggcacagagcttaaggaaaaccaacggtggcagatggaccagaatgagcaagggcagcctctccctgcctccctgcagggccccctcagctcaaagccactgacaggtcagcaaggttcaatggctcaagccaggcaacaggtcatctgcttcctcctccctacctactgggtaacctgggcagggcacccacctttataggtctctccatctataacctgaagcaaaacaccaaacaactgtccttgcagatgtcgcgtggcaggcctggtatcagcaagctctaaggagtaggtgccagctcagtccctgcaaggagtgtcctttaagctgactttcctgttaatttgacactgagcagcactcctgtcctttaagaaaaatgcccaacaagctgactcaaaaataacagatgccaatttgcatattatttcacacatcatttgcatgctgttcatttagtatcatcaaggctctgctcagaatacaactctggttaccctgtgcccagggcttgtgaaacagatatggcttccacaaagggcaagccctgggcacgtccctcccctgcccagctgctcttgctgcctgccccctggcacctggctgggaacgtcacccactgccacagccctggtgctccaagcagggtgaaggggcagaaagaatctttagaattctaggaagcaccctgactcaagtcttgaaggggaaattgtgttctcttgacgacgcatcaggcaagctgtggcaatgcttttcttccctgcttctgtcccaggtcagcttcctagttcggctctccctgtggccctactctctcagcctttttctgcctggtcatcgtgtgtccccctgaccttcctccaggcctctcagcctctggcctggccccacgggtttatttttgttctctctccacctgtccgatttgcatgtccacacccggttagctctgcccagaccacaaattgctaactgagtgtagaataacagggccccatggggtaagaaggctccagaagtccagcccaggccaccactgcagccctgccctccggagaacagcccacttcctttttactcacacagattcacccaacaaggtctatccagaaacatgactggggagcttgtcacggacgggaagccatttggctcatgagaaaaggggcatgttccacacgtgctctccaggcagggacacctgcagacagtggaggggtgacatgggcgcatatgcccctcctgtcttgatgctccaggtggcatcttctaaccaccactctaataaaggcaacagttgccagctgctgagacccagtgtgtggctggctctgtggtggctgctgtgctacagccagtagttgtgattccctcttaacactgaggaaataggctttgggttcagtaagttcccagagcgcccatcactggtgtgccacccaagtttttttttttttttttttttgagatggagtctcactctgttgcccaggctggagtgcagtggcgcgatctcggctcactgcaacctccgcctcccgggttcaagcgattctccagcctcagcctcccaaggagctgggataacaggcgtgagccaccaggtccggctaattttcttatttttagtagagatgaggtttcgccatgttggccaggctggtctcgagctcctgacctcaggtgatccaccctccttggcctctcaaagtgctgcgattacaggtatgagccaccgcgcctggccccaagtccttaactaccaagcctggccacctctaaaaggaaggatatcaggtcttcggggcctgagtgtgcagaactctgcagccctggtggttactgatgctaccaaatattccatccatcactgtgccctcgccctgggcctgtgttcactgcctgcccaaagcctctccagacgagacagtctcctctttcctccctacatgcccctgtgtgcaccacacggcagcaacctgaagctgccctcatgcctgctctattccctacacactctgccccctctccccgggcttctcacactcagaattgagcccctgcccgagcccctcccatcatggcttgtctagtccttcagggaccccccaacctcctacagggaatccacccagcatccccagtctgagtcactgtctccttcctcagtcctcccaagcaccaacaccataaaccaccgtccgcctgggatggatgccatctgggtgctgtctgacacccctaagaacaggactctccggactgtggctgctcatcctcgtgatgaaacatgatctggaatcagattgcgaagcctcggcacaggaagggagttcagctcctgtttttaggccagagaaacgaggcccagagaggggaagggactcgacaaagatcacacaacaagctggaagcaagaggcagaagcacctcctgaggggctcaaagcagagacgggccttttctcggcactcactgcccatgacagagctcaacagaggcatgaggcacagacagggacgcaggaaaatgggactcaagaatgaaaaagaaacttctagaaccaggaatggagaagcccttcgaggtccctcactcaaatccccagcagaagtttgtggtggggtttggaatagggaaatcagaagtgtactgagacctgagctctcattctagaaccctctctttcctgagatgggcacctggagtgaggcactcaaccctgggaacccctgtgcagccgagttttctcatccctgagatagttggtcatcatgagccctgggccagccaccgtgagggtcatgagggacccaggggtgaaaatgccttgtaagatgtaagatgctgagctcatgtgactgtcccccgataaacagccacacagccagtgctggaggagaaaggcagcctaagagaagagcaaggtggaggtgaggggtgagagagttatgtatggacatgtccagtcaggtctaggggtcctgctggccctccaggggtggaaggtgggggtgctaggggctgtggaaggagcttttgcaggaagggctttcattttccctgtattctccacacctaccctcctcacaacctgcccggtatcaccctgagggcagcagcaccagaccccagagaggaggcatcaagaactgaccttgggccagtccacaatctcaccctgatcccaggccaacctggggtgcccacacttgccctggccacccctccagcactgtcttctccaggacctgcgccagcatctcccgccctccatcaagcccttcctgcccagctcgtggtaaagttcctcctgttccaacattttgcatcacgggtctcagtgccataaactcaatttttctcttttaaggatatgggcagcagcaggcaagggaaagggcatgaacttgggagctaaacgggcttgggttcttatctcagtgccaccaccgctggcagtgtcagtgtggcccggtgacttcatctacacagggggcggtgagcacgacctgctccttgtactcccgggtgtaatgtaaagccagcccagcactcagcaaatggtccttgccttcccctctcctgtcactcagcaacatcccggccagcccagcgaagtgctgggtgaccagaaagtagcgtggtccctgcccccagctgctcctcccctcctttccctcagatcccagctgagctcctgggggtggaatgacagggtcgggggagggggcacttaaaaacccattcgcctcctccggactttcctcacccgaagaaaaggcactagaattttcctccctacagctcctgggaaaagcacagtctcagaattccccaccctcattatttaaagaggaataggtgccttgctttcttgctctccttttggggttttgaaagaaagagaagaaaaagaactacaaatgaatgtgctggcctgcctgtcactgagctgagtaaagtggtatttcatcaatatacagccgcccctcacaacccccgcacacactcattttctcccccaaatgtgcttcacaaataactgcaacagagctgaagcgctctattctgatcttacatttccatccaggccccagattctctacagaggttactcaaatttcttttcattttgactttctttaccttatatttttttaaagcagatcttttgaccatggccttacaaatccctcttcctaaaagcacaataagagaaatacgaggcatcagccgcctttctacttaggctgtgcaggagataagtgccccagccaggatgcccctggcggagcacctgggtaatgccgcctgtggggaagggaagtccggatgtgtgatgaagtctttccccaggacagttataaatagtgtgatgacacgcaaaggagaagcatatataaaaagttagctgtccccctgtgggttacagatgtttgactcatttacagactgtccacaaagattataaataaagtcaccaccaccctggggcgggtggcggagaaggccattttcacgctgtcaaaaggccattttcacgcttgccctcctgtgggccgacacactcagtgtgacctgtgaagacaaaatgtgtgcctagggccctcggcagtgggctcgcaggctctcagccagtctcctgccttctgcatcctggtcctgcaggtcaccccacagggagggtccatggaaagggctggaaagggtctatcctactcctacttttccaccatggcctgaaacacaggcaccagtacccagaggcatcttctcaaaaataccaggacactgtgacagccaacaacctatcccaaagcagcacctgggtccaaacagaaggtgcagagccacttggctagccaagcctgcactgctgctctgcccttctgcagacaaggcttccgtgaccagggagagcagaggatcagaactggttccagtgatactactcaatcatttggtctagaggctggggatggactcagggacctctgtgaggtctgcaaagagacagacaagttggccttggccattctgtttaaagagtgaatggccagacgaccaggctcccctgggcatacggagaagcggcctcccatgaggttgtctgaagaaagagtaactagaagtgggaaaagaagacactgtgggagcagacagggcagcctggataagcatcttcacaccaactcctctctgccacctgggttaccccagcaacgaggccaggcaggggccacagagaggagcagaggggcaggaaatcagtggggcaggcgagacaggagcatggtgggggagtgggcagaggactggttctgcctgggaggagagatgcagaccagtttcaaggccgggcatggggaagtggcttgaggttgtacagattggtggaaaagaagagccatgctgccacaccagcactctccagcctcccctgagaagatcccacagcccaacgcctgagatcccgagaaacaaggcccctgggtgccttgccagccacacagaggtaccagctcagccaccaacatgatggcagggtcagggtggtgaagtcacagcctggggaaaggggagggcagccaggcctttcccttccctaattctttctgaacccagggaagagagcatacaggtaatttaatgcaatggagtgggtgtgccccaaaccagctctaaaagaaaataaagaacactaagaaggactccccaggtccttgctggtctacccaggtggcaccgatcagtacagatgatgtgattaagattctcaacagaatctctagaccaggcctcgtcacaatgtctaagacttcagagagtaaacctgcctattaaaaaaaaaaaaaggactcctcatttggttcaagggtcacctggtacctttaggagcccactggggccatctcaggcatctctgccgtttgatctcatgtcccaggcataataatgagaagctctcctcttatctgagctcacccaggaatcaagccccacctccctgctccaggctgatgcctcctagcagagcttacttccatcatcagcacctacaggcctgtgaggcaggagctggggatgttctgtcccggttgctcaaccccctcacattggctcccatttgcattaactgaacatgctcagggcacatgccaccctccttttcaaaagacccaggcctgcatgacaagttacttccccagcagcagccacccgccaaacataggtgaacagcaaggccacaaccccacggaaaaaaaagcagagaacttcagaaagcagcagctcaggcacaaggttagttaatcttcaatcacctggggaaaaaaaaagtttgtcacctcccaagggcctttgagtgggagctgccactggatgggcagaattacctaatctgcctggtacccctgaggttgccttgtccatccgcctgcctccagactggtcagcagggccaaccaggcacacaaagctctccagcaaaagagtgtcacccatccctccccagggtccactgaatgtccctgagctctcctgggctgtgactaacccagaccatggaggagtagagaccacttcctccatgaaactgggacacagatattcacctccccccaagaataaaccatgcttaaaggtggtctctagtcagacccagtcccttctcaggacttcttccctcccagatacaacttctcactccgttgacaagtcttagatcccaatctgttaaagctccaactaattttacagccagagttagataacaggaaaaagatatctcctttcctctcatcattgtcatcatcagtaacaatcacaataggtcccatttgttgagcaggcagatacgtgccttacacgtctctaatttaattctccctactcgacagctggggaaacaggctcgctaaagctccatgacttatccaagatcacacaaatagtagtggcagagctgggattccaactctggcccagttccttgaaatgttcccatttgcctccaggagagagggatatctatcttggccctgcagtgtgtacaaggcctggtacataggagacacccagaaaatacttgtttcataaatgactcaaaacatggatggacagtgcagggatgggtgaatgagtgagcaagttaaatgagctctgcttatctcaagaccagccccaaggcacacaggaagtggccgctgaggcaagaaggacctctcagctactgccccctcggtgcacgccactgctgctatgagggtctgtgattcagaaatgcggggagccaagcacctcaggtggcctcccctttcattcacctaaaatctgccttccgcatctctgggaaagcccctttccctgagctccccctcaggggtggcacctgccccaggcagggaagagggcctgatcctgcagagtggtgactctcccgtcgcgttaagacaaatgtgcatagatcccacactgggatctgtgcacagccactgtctctgggaatagccgtttccttaagaactctgactacgggtgtcactgaaagagaaggtgctgggattgccccttccccacaccccccttgcatttgggccttcatcagttttccccagtgagggcccctggtctccaagggaggactggagagagccagggctgtgaccagggcagctgccagtcctagcgaggctgccagccccatatcctggagcgcccagcaggagaggcggttctgagaaggcagcgagcagaaggacccgcagacgcagaggctcattacagggaatgactaagtgagctgcgcttccaagggaaaccccactcgcttctgctcgctgagacgctcatccttgagctattttgactaaggcggcttccaggtgctgccctccgctggggcagcccactgagagagcagccgggttgctggaggaccctctgcctggaagtcttggtcctggctattcaggtcgtctgacaggtctgccccacccgtttccagggcgggaaagtctgcccatcaccgattaaagtgagatgctgggaatgggggaaatccgatcagcacctcctaggtttttgcggctggatttcaataaggaatgtgacagtctcgcagcagctgtgccctgcctgaaacaagctctatttgaaacctccaacagctgaacccctcccagctacccgatggccagcccgcccagccacccccccaccaagccaccccctgccccaaatgacaaataaatagaaaaacccaagcaacaagcaggcgcatgcatacgtacaaacattacgcacatacacacacacacaccaacaaattgggggtgggggtatcgtggagccacttgtccaccgattcccaggtctccaagccttccagcccacagcaggagagctccccggcaagcagagcatcggcagaaacccaccttcctccatctccactccctctgggagggaaaccccctcctccgtcttggggctggactgagaggctggagcagtggggccagctccccgctaaagccagtgcctgctgttctccatccgggcgcgcactcacacacacactcatctttatttatcccaaggaggagttgaggtgggaggggagaactggggctgagctggggcgcgggcttgtggggaccgcctgggaagccctgtcatcccgtcccaaggagaggtgctcccccagctgattccaaggcggcgcccagctgctctgcccaggtaacacctgtagccatttttatcaggagatgtttacgaagcagcagcaggtttattctgagtcctctctcctgagggaaaggaccactgatttcctccacctatatttttaccccatgccctcaggagacccaggtcatggatggttttctattttgcccgagactctctgagaagaggagggaaacagaaacttgggaagagatggagaagacagggagagaagggacttgggcaatggtacggaatccccaccccccacccagacatttatttcttttttatcctcaggaaaatggagtggagcagggaggggaggaaagaaggggaagtcgcaggaactggcaaacacatgaaggcggagtgtaattaattggtgcgttaagctgctgggttatgctttagtacgagtgagccaggaggaaaagcgatttctcagaagggattattgaatcctccctaacagagagtctgcaaattagacacagtgtgtggggatgtcccctaccccccagaggaagctaggaatgaattctcccgggatcaagaaggaaaaccacgggaagttagagtgttgaatataactgagcaagcgcctctcaccaccaccaccacctctctctcccagtctccctcccaatctctcaatctctctctctctctctctctctctctctctctctcaatctctctctctcacaatccccctctctcaatccctctcttgctacctacatattccttttgttcaaggtataaagagaaaccacagcccctacctttgagtacaaaccccaagagagctcggtctctatcaccataacaacaattccaaacatcccaaaaatcagagcatagtcactcagtcgctttctcttttcaaacagggccctcctgtgtcccagcttatagccaatgttttggtttttccgcttgttggctttggggaaggtggtgctgctggcggtggtgccggcatgctggtggttgtgggtggcattagggtgatggagcagggtctggtgggcatggttgtcctcccgggaggagatgacgatctccggggggttgctagggctgaaaagctggaggggttggccctcagtctcggcctcgatgaggttcctccgggaggcgctgaggcggctgaggggcttcatgaccccaccgctatacttgcaggagctcatggcgatctccgtgaaggggttgctgtcccgccggtgcaccagggggctggcctgtcggtgccggctgcctccgccaggcccacttgtagctgtggaacttggagagtggccaagcaagtggtcattgagattgagctggctgccttgcctggaggaagggtggaggatggcggtggagttggacgaagggggggccctgaaagcggtgggagaggagtgcagcaggccagggtggacgggctggctctggagttgggcgagctgagacaggggatgcggtggctgctgctgctgctgctgctgctgctgctgctgctgctgctgaagctgcggaggctgaggctgcagcgagggtcccaggggctgctggggggctgctggtggcgctggcggtggtggctgctgctgctgttgctgctgctgctgctgctgctgctcatccccagaggatggacaggggcacttggggtcttcatccaagtcccccacccccgagtcatggaagtgcccagaagtgtccatcttggggcctggctgtattccctgcagcacaagcccccaccccaaagccaccctcgctccaaagatgtcctcaaagaaagccaggcatccaatctcccccaccagtatcttggctccagtcctctctttggcttgcttcggttctctggggctgcctggagtccagacgctgccactcaagaatgcattgtattgggcagggagggagagcaggaggggagcttggagaaagaagagggggtgaaagaactctctcaggaggtggtcctctaggagcgtgtgaggccaggctcagcttcactcctcgctggctc

SEQ ID NO: 902 - DNA, 172814 bp, Homo sapiens; identical to SEQ ID NO: 901
